United States Patent 8,065,093 (METHODS, SYSTEMS, AND COMPOSITIONS FOR CLASSIFICATION, PROGNOSIS, AND DIAGNOSIS OF CANCERS) - sequence listing, part 2

SEQ ID NO: 162 - DNA, 1755 bp, Homo sapiens
tgtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagcaccctagtttcattctcaactctagccctgcacactcacctatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcatatttggtt

SEQ ID NO: 163 - DNA, 699 bp, Homo sapiens
tgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcccaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctcttacactccacggctcttcttcacagccacctcacgtctcaccctcaagacgcttccctctccgccttctcaccgttctctcgcggaatactttttccgcatttcgtactcccagcacttctggcgaggcgaggcgtgcggatcgacgacctgttcggctaacgcggctactctcgcttctactacccctaccactctcgccgggccgtggggccgtcgcgtgtcttccacacctcgggtgctgcgccgaatcccctacctgcccgctcggtccgtgccccctgcgcctcgtc

SEQ ID NO: 164 - DNA, 689 bp, Homo sapiens
  modified_base (512)..(512): a, c, g, t, unknown, or other
  modified_base (603)..(603): a, c, g, t, unknown, or other
  modified_base (646)..(646): a, c, g, t, unknown, or other
ccgaaaatactttaatgcgaggtcctcgtgtgggtcgtgttttggagagataactggccttggactggagggtggctgccttcttcctttgccaggtcatgcgaggggctgctggccaccccatgcacatgcccctgcccctccatgtcagatgcgtgcccctcggggctggccgtgtccgatgcaggccccttccggctgttgatcttgatggcggcgcgcagcgccgacttgaccgccgtctccacccagccgtgcgggtaggcggtgtgctcgccggcaaagtagatgcggccataagggaccgtccagtcatccttttcggtttgccagagcgccggcggctgtaccacaaagccaccctggctgtgctggtcctccgcccaacgcttgacgacgccggtgccgtcccagagctggcgcacgacaggcccgtgcaatgccgccacgtcgtcgagcgccaagcgcaacgcctcttcccggctcaagccggcgaacgcttgccgcgcgtncgaccacgtgtacgaggccagcagcagcgcgccctcgcgcggcggcgggtagaaaatcatgcgcgacgggcgatcggtgttgagtggccgncttttcatgtgctctcgcgccagaagggcctgcggaagcttangaacaacctttgtggcccgcacgtagtgcagccttcgcagcgc

SEQ ID NO: 165 - DNA, 503 bp, Homo sapiens
gacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggca

SEQ ID NO: 166 - DNA, 1869 bp, Homo sapiens
ggcgccgggggcgggggtgggaggcggaggcggggccggggcgccgcgggcggggcgccgggggcggggcgagtccggaggactcctcggactgcgcggaacatggcgttctggggttggcgcgccgcggcagccctccggctgtggggccgggtagttgaacgggtcgaggccgggggaggcgtggggccgtttcaggcctgcggctgtcggctggtgcttggcggcagggacgatgtgagtgcggggctgagaggcagccatggggcccgcggtgagcccttggacccggcgcgccccttgcagaggcctcccagacccgaggtgcccagggcattccggaggcagccgagggcagcagctcccagtttcttcttttcgagtattaaaggtggaagaaggtccatatctttttctgtgggtgcttcaagtgttgttggaagtggaggcagcagtgacaaggggaagctttccctgcaggatgtagctgagctgattcgggccagagcctgccagagggtggtggtcatggtgggggccggcatcagcacacccagtggcattccagacttcagatcgccggggagtggcctgtacagcaacctccagcagtacgatctcccgtaccccgaggccatttttgaactcccattcttctttcacaaccccaagccctttttcactttggccaaggagctgtaccctggaaactacaagcccaacgtcactcactactttctccggctgcttcatgacaaggggctgcttctgcggctctacacgcagaacatcgatgggcttgagagagtgtcgggcatccctgcctcaaagctggttgaagctcatggaacctttgcctctgccacctgcacagtctgccaaagacccttcccaggggaggacattcgggctgacgtgatggcagacagggttccccgctgcccggtctgcaccggcgttgtgaagcccgacattgtgttctttggggagccgctgccccagaggttcttgctgcatgtggttgatttccccatggcagatctgctgctcatccttgggacctccctggaggtggagccttttgccagcttgaccgaggccgtgcggagctcagttccccgactgctcatcaaccgggacttggtggggcccttggcttggcatcctcgcagcagggacgtggcccagctgggggacgtggttcacggcgtggaaagcctagtggagcttctgggctggacagaagagatgcgggaccttgtgcagcgggaaactgggaagcttgatggaccagacaaataggatgatggctgcccccacacaataaatggtaacataggagacatccacatcccaattctgacaagacctcatgcctgaagacagcttgggcaggtgaaaccagaatatgtgaactgagtggacacccgaggctgccactggaatgtcttctcaggccatgagctgcagtgactggtagggctgtgtttacagtcagggccaccccgtcacatatacaaaggagctgcctgcctgtttgctgtgttgaactcttcactctgctgaagctcctaatggaaaaagctttcttctgactgtgaccctcttgaactgaatcagaccaactggaatcccagaccgagtctgctttctgtgcctagttgaacggcaagctcggcatctgttggttacaagatccagacttgggccgagcggtccccagccctcttcatgttccgaagtgtagtcttgaggccctggtgccgcacttctagcatgttggtctcctttagtggggctatttttaatgagagaaaatctgttctttccagcatgaaatacatttagtctcctcaaaaaaaaaaaaca

SEQ ID NO: 167 - DNA, 3032 bp, Homo sapiens
ctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaaaaaa

SEQ ID NO: 168 - DNA, 992 bp, Homo sapiens
agcgtttaaacttaagcttggagttatttccaccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcctgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgaactagtactaagccgaattctgcagatatcc

SEQ ID NO: 169 - DNA, 465 bp, Homo sapiens
  modified_base (5)..(6): a, c, g, t, unknown, or other
  modified_base (363)..(363): a, c, g, t, unknown, or other
  modified_base (372)..(372): a, c, g, t, unknown, or other
  modified_base (380)..(380): a, c, g, t, unknown, or other
  modified_base (403)..(403): a, c, g, t, unknown, or other
  modified_base (410)..(410): a, c, g, t, unknown, or other
  modified_base (437)..(437): a, c, g, t, unknown, or other
  modified_base (445)..(445): a, c, g, t, unknown, or other
  modified_base (463)..(463): a, c, g, t, unknown, or other
aaatnntgagtatgtatttattttctaggtttcttacttccagtcatgacaaaataatggtcatcatcttcctttttctttgcagtaggttttttatctccactatctgcatccttaacagatgagggtggtttcctgattgaagctggggttttgccacttctgggaggccctttagttgaatgctggctcttagcgacagtctgtgctgacttcggtgcagtttgtgttttggtagaagactggggtaggctcacgatggacagtggggtacggccaggagacttcaaggagctgggtcctgtcttctgaaatgcacttttattctgaggctgctttttgggagctgaaaactataattcntaatctttngaatttcngtgtggcctttaacaggagaaanccgaggncacagaaaccggccgattttaaaattncaaggccnatttaaagttcccgtgcngg

SEQ ID NO: 170 - DNA, 361 bp, Homo sapiens
tgaattccaagaaagttttatttttaaaaatcaagttttgatataataaatgttggattgaggatagaaatttaagctgagaaatgtttaatttggacctaaaaaagtttattattactattattattgtggaaggaaatacatacaggcacattttagtatctacaacagtatttgggaggctgttatgaaacacaaaacttcatttaaattttattataaagacctttattaggagaaaggacatattttctatttcttacttttattttgtgccttgaaggacttgtgaatgtatagaataattattttttcttactgcttcctctttgcaacccaacctccaccaagtcaatcgtga

SEQ ID NO: 171 - DNA, 968 bp, Homo sapiens
gaattccgacaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcagaagcataatatctcctggatatcatgaagcaagatataagagaagaacaaaacaaaatccgtaattcattgaaagaattgtaatcatcaatctttcatattattaatactttgtaattattttctccccaacagtattttccagtagattctaatcatgtggtagggcagaaggaaatgtgttttttgttgttcatttgtttcttgtcaatagtcctgattattttagctttgctatactgacttatatctggaagtatataaccaagataagaaaataggttttaatatgatcatcttaagctaattgtaatgaaaagaactaatggactgtcaatattcagaaaaccaaaaataaaaaatacggaaaactaaaaaaaacccgaattc

SEQ ID NO: 172 - DNA, 4574 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgaggcagcccgcgggcgtcatgcccgcgctcctccgcagcctggggtacgcgctgaagcccgggaggcttggcgccggcgaagacccaaggaccactcttctgcgtttggagttgctccccacaaccccgggctcgtcgctttctccatcccgacccagccggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaactt

SEQ ID NO: 173 - DNA, 2232 bp, Homo sapiens
gaaattgcacacttaaagacatcagtggatgaaatcacaagtgggaaaggaaagctgactgataaagagagacagagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtctctttacacatctctgctaaagcagcaagaagaacaaacaagggtagctctgttggaacaacagatgcaggcatgtactttagactttgaaaatgaaaaactcgaccgtcaacatgtgcagcatcaattgcatgtaattcttaaggagctccgaaaagcaagaaaaaataacacagttggaatccttgaaacagcttcatgagtttgccatcacagagccattagtcactttccaaggagagactgaaaacagagaaaaagttgccgcctcaccaaaaagtcccactgctgcactcaatggaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagatactaacattttgcactgtcaaaatacttggtgaggaaaagatagctcaggttattgctaatgggttaatgcaccagcaagcaaaatattttatgtttcgggggttttgaaaaatcaaagataattaaccaaggatcttaactgtgttcgcattttttatccaagcacttagaaaacctacaatcctaattttgatgtccattgttaagaggtggtgatagatactatttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgtttt

SEQ ID NO: 174 - DNA, 464 bp, Homo sapiens
gtattcttagtagagatagagtttcaccatgttggacaggctggtcttgaactcctgaactcaggtgatctgcccaccttgacctcccacagtgctgggattacgggcatgagccatcacgcctggccaactgaagtgttcttgatgttataatcctattatttttgtaagagacaagaaagtagatttgaattctttgtcatgtgctaagtcaagttttcctttggcaataacggtttctttcatcataaggagctcatgatgcatggttctgtacccatcaatcatgctgtttatggatctttaaacttattgcctagaaaaatctcaggcagttagcctactgtgtatcttttaccaagctgcatttattttattattttgttccattgttttggaggatggttgggcaggaggtgtctggatccctgaagcaggcaaggaaccctttcccaaagccaact

SEQ ID NO: 175 - DNA, 378 bp, Homo sapiens
ttttttttttgccctttattgacttgatctttggatgtttgaggttattagggatcatgtttcatttcccttgctttcaaatacagttcagaataaggattacatgaagtcactagcagttttactatgtctgaactagtcctgaaagtaaataaacatgcacatcctgagcactaaaagagttgcagaattaatgatactccaatctctcaggccatgtgtcagttggaaactaacacaatggtgagaacattttaaatatttacagcctcatgatgtgaacaaacagcattctccctaaaagagtagactgtaactctacaccaagttgaaagaacagtctgtcaaacatcaggaaatagtcacaaaaaactggat

SEQ ID NO: 176 - DNA, 2529 bp, Homo sapiens
cttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttctcaattaaaggtaatccttactttctttgtattacttaggttcttaaatttctatgataaacatgtattgct

SEQ ID NO: 177 - DNA, 5433 bp, Homo sapiens
atgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaattaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtctttt

SEQ ID NO: 178 - DNA, 807 bp, Homo sapiens
atgggctcagccaagagcgtcccagtcacaccagcgcggcctccgccgcacaacaagcatctggctcgagtggcggacccccgttcacctagtgctggcatcctgcgcactcccatccaggtggagagctctccacagccaggcctaccagcaggggagcaactggagggtcttaaacatgcccaggactcagatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggttctatgcgcaatagatggaaaccaaacagcagcaaggtactagggagatcccccctcaccatcctgcaggatgacaactcccctggcaccctgacactacgacagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctag

SEQ ID NO: 179 - DNA, 1216 bp, Homo sapiens
ttcggcacttgggagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccagggagaaagaacttccccatacaaataaggcatgaggactatgtgaaaaataaccttgcaggagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtgggggcggggccggggggactctggtatctaattctttaatgattcctataaatctaatgacattcaataaagttgagcaaacattttactt

SEQ ID NO: 180 - DNA, 1704 bp, Homo sapiens
atgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatctgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaaaaaaaaaaaaaaaaaaaa

SEQ ID NO: 181 - DNA, 798 bp, Homo sapiens
agtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgtttgttaaaaaaaaaaaaa

SEQ ID NO: 182 - DNA, 524 bp, Homo sapiens
  modified_base (378)..(378): a, c, g, t, unknown, or other
  modified_base (401)..(401): a, c, g, t, unknown, or other
  modified_base (437)..(437): a, c, g, t, unknown, or other
  modified_base (476)..(476): a, c, g, t, unknown, or other
  modified_base (487)..(487): a, c, g, t, unknown, or other
  modified_base (493)..(493): a, c, g, t, unknown, or other
  modified_base (514)..(514): a, c, g, t, unknown, or other
ttgtaggttcaactcaaatgagtttatttattaggaacttttgaaacactgaggttgaacagagaatgggaactagacagatcatttcagcatagatggttactttccctcttgccacagactctgcaggaaatgtcaattactgctttctttctccattatgttcaatcctttccaaggcagtcagagagctctctcccttcccattaagagaggatcttctccggtagcctttgaactgggaagtggctttagtatttgcaagtgtagatatacaaaagctcttccctcctcttaccagggttcatcgggaaggaacccagcagcagggccctggggtgttttctgggatcctgaggacgggagggtgcccatctncgggtttttgtctgggagggcanagtttcttttatgggggagacatactttcaaatccnctgcttgtccaaacgtacatattgttcttctttttggcntttttggggantggganggaagtggaagttgaaatccntacaagaccc

SEQ ID NO: 183 - DNA, 923 bp, Homo sapiens
ggcacgagggcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcaaaaaaaaaaaaaaaaaa

SEQ ID NO: 184 - DNA, 2357 bp, Homo sapiens
  modified_base (1391)..(1391): a, c, g, t, unknown, or other
gggaccaccttcttttggcttcaacctctcccactcttgacatctgagtagctcagggaagctcttccaggtccgactgttcatatgtaaaggagactggccgctgggctcaggaccgggattatccgagctctgcagaagtgcaccgctattgctttgggagggaaaaaaaaaaaatcacacggtttccagtgaaaaagtgacagagggtggtggcctttggaaccgtcgtcccgtctctccctgaacccgaaacttgcatgctatggaacacccgctctttggctgcctgcgcagccctcacgccacggcgcaaggcttgcacccgttctcccaatcctctctcgccctccatggaagatctgaccatatgtcttaccccgagctctctacttcttcctcatcttgcataatcgcgggataccccaacgaagagggcatgtttgccagccagcatcacagggggcaccaccaccaccaccaccaccaccatcaccaccatcagcagcagcagcaccaggctctgcaaaccaactggcacctcccgcagatgtcttccccaccgagtgcggctcggcacagcctctgcctccagcccgactctggagggcccccagagttggggagcagcccgcccgtcctgtgctccaactcttccagcttgggctccagcaccccgactggggccgcgtgcgcgccgggggactacggccgccaggcactgtcacctgcggaggcggagaagcgaagcggcggcaagaggaaaagcgacagctcagactcccaggaaggaaattacaagtcagaagtcaacagcaaacccaggaaagaaaggacagcatttaccaaagagcaaatcagagaacttgaagcagaatttgcccatcataattatctcaccagactgaggcgatacgagatagcagtgaatctggatctcactgaaagacaggtgaaagtctggttccaaaacaggcggatgaagtggaagagggtaaagggtggacagcaaggagctgcggctcgggaaaaggaactggtgaatgtgaaaaagggaacacttctcccatcagagctgtcgggaattggtgcagccaccctccagcaaacaggggactctatagcaaatgaagacagtcacgacagtgaccacagctcagagcatgcgcacttatgatataaacagaggaccagctccattctcaggaaagaaatgttgtggatggcaagcctttacccaaatatcgtttacacagagagatgactatggcagtgatgtttaatattattaaatccaggcatttcgaatctgtttttcattgatttattagagggtttacacaaagagcttccacagtgaagatggagaaggtgaacttgctttgaatatnccagatttgtttggtcatgcgtatggcagtgagcaggtatgtgttttcttttcttcacgaaaattaaattgctatcaagagcaaactatgaacattatattcaagatgtctccagagtgaagatgccgaggatgaacttgcattgaacattccagatgtgtgagatcatgtgtattgcagtgggcaggtatttgcttttgcttgcactgaaaattaaattgctatcaagaataaaccatgaaacattttatcctgaacagccacagtgcctgaattcactcaagtggataaaaaagtgtattttaactctgtatattacccttaagtcattttcctgtcttcactaatttagcaatgcattcatattagctgatgaaataggcactcacaatgacaaccagagccagtttcttgtctttttatacattttgtcatcccagagactcggtatttgcttactgtgtttcaagtagaggaaatcgtggtcttgaactattctgtaccacagcaaacaatctatgttgctttactatcaactgctgtaatcgtttataaaacttacctagctccttcccttcttctatcatagctttaaacattagaattcataggcaaatcagttaaaacattaggatcataggcaaatcagttaccttgcagaaagagctttgtatgacagacattgtcttattttatttctgtaaaatattagctgtatgaatatgatttaattaacaagaaaacatttcttcctgattgacaacagtgttagcaaggtgcaaagcgaaactggttgctcaagttgatagaaaacaaaattctgaatatcttcaaattaattcggtaaaaacacattattttttcatatgtgatgtattcatgcagaacaactatcttgtattttgtttttaaaatgtgtttaataaatgatcctttgtaaataaaaaaaaaaaaaaaaaaaaaaaa

SEQ ID NO: 185 - DNA, 433 bp, Homo sapiens
tttacagctgcattagaaagttaacatgggggcaggggtgggggaaggagtccgagagcctgaggcctgagaacaagacgggaagacattgctggacatttattttatgacgtgcctcatcagcagaacaaagaagggcatggacttatgtttaaaaactgtccagaagtgaccaaagaaattcaccagtgatgcagatgagctcctaataatcatgccatcggagcaggctgtgatagcctggaaatcctgcctgaaaccaaactgcaacatttccaactaagaaatcaagcggtgataaacctcagtatctgaaagggttaaatattgtgcccacgtgactactgttctttctttctgtgaattaatgtgtgtgccagaaaatatttgtgaataaaaaacaattacataatctcattgtcatgaatgtggt

SEQ ID NO: 186 - DNA, 1658 bp, Homo sapiens
gaattcccacctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctaaaaaaaaaaaaaaaaaaaaaaaaaaaaaaaaaaaaa

SEQ ID NO: 187 - DNA, 3504 bp, Homo sapiens
agtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcacctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcaggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaac

SEQ ID NO: 188 - DNA, 569 bp, Homo sapiens
  modified_base (422)..(422): a, c, g, t, unknown, or other
  modified_base (457)..(457): a, c, g, t, unknown, or other
  modified_base (466)..(466): a, c, g, t, unknown, or other
  modified_base (471)..(471): a, c, g, t, unknown, or other
  modified_base (493)..(493): a, c, g, t, unknown, or other
  modified_base (511)..(511): a, c, g, t, unknown, or other
  modified_base (517)..(517): a, c, g, t, unknown, or other
  modified_base (554)..(554): a, c, g, t, unknown, or other
  modified_base (558)..(558): a, c, g, t, unknown, or other
  modified_base (566)..(566): a, c, g, t, unknown, or other
ataataaagtctgtttattacagcaattaacagagcagcgtttgccggcatgcttttcagtggcaaccagaaaagtgcttactccaggtgcatagattcgggaaaccatgcaacttgagccaaaatgaaaccaattagaggcttagtaaatgggttccagccaccccaggaaacttaaccatccacgagtcagttcagccgaggtagaacctcagtgcaggaatttagcatgatatagattgctactttacagaattaatccagacctgtcgccagggttgtggtcttgaggacgtgaaatgtatccgcccaacacagccacccaggtgctgggttcaaatctcgataaactacataggggtatataggtggggaacgttagcaccattgactcttaagggtctcttgccactgccatggangtggggacataaggagaggactagaagctgggccnaaagggacnagacngagaaagaaccgaaatccttcnttaacctggcttcaaaanctggantggaaagtggccgcttgataggggtaagaggaattcntttnacctgganaaa

SEQ ID NO: 189 - DNA, 593 bp, Homo sapiens
  modified_base (489)..(489): a, c, g, t, unknown, or other
  modified_base (533)..(533): a, c, g, t, unknown, or other
gtaagcagctccatttatttgagtaaatatcttgtaaataaatcattggtaaacaatacaaaattaaatacattttcaaaagcttgccagtatacgcaaaattcacaaacatagtttttttaaaaaataaaatatgttcagagcacccttgatataaaatgcctgacccccatccttggacaaggccacctgaagacatcttatggtaggtgggtttctgtgggagtcagcgggggcctcctggagggaagggtttctactctcacctattacccatcccacattccatctgaattttgatccttctccaaagagctgggtaactgagagggctagagcacgccaccaggcctagctccaagcacggggatcagggtgcacaattagggccaggagcacccagagtcctcaacacaagccattgagagaagccagaaatgcaatctccacacttccaaaccagcaactcagctcctagagcaactgtcntgagagaatgtgaggctttctcaccttgacacttaacactcggnttactcccactgggtctgatactacccaggcacagaagctaccagaacctattttttatt

SEQ ID NO: 190 - DNA, 778 bp, Homo sapiens
gtgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggttggagctttacctcttggcagtatcccttggaagggagctctgagattaaatgtaatcaaacacttatgagagctttctatggaccaggcactacactagacgctgggaattacagaggcaattacctgtcctatactcaaggtgttaatgatctagtgtcatttttctttaaaaaagaaagcacctgcattgtcatcttgagcaaatatagtaactctaacctcaaggttcaagtgatttactcaaggtttaaatcatagttgtttggagaaagtaagtgtcagatgcactgtggctgtcagggtcatagtaggcatttaatcaacatggttggtgttcattaaatgtggattgaagataaaatgactgatcttaagtttcatgaggaataggttgcttcattgaaactggtttttatcttcccaaatagttttcaatcattcctttaaagtactaggttgattaatattggcaaagtgtaatgtaaaatgtgacttacctctgtctaacctgtattgtcacatgaatgggagtttgactttggggaataacctcgaaatttgcgggaggacccaaaaaaaaaaaaaaccggaggataatgtggggggaaaaaagtaagaagg

SEQ ID NO: 191 - DNA, 8671 bp, Homo sapiens
cgggagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtagaccctgactttgaggaagaatgcctggagtttcagccctcagtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttggcatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagttttggatgaaagcaattcccaggacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgttgtgacccacgaggactgcatccctgaggttaaaattgcatacattaacttcctgaatcactgctatgtggatacagaggtggaaatgaaggagatttataccagcaatcacatgtggaaattggttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgtatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttctctacccgcttaagggagtccgaggaggaaccctggagccccactggtcgggactcctgtggacaggcatgctcatctctctgggcatcgtcattggcctccccaatccccatggcatccgggccttaattggctccactattctacgactgatattttcagtcgggtcacaacccgcgttgtttcttctgggcgctttcaatgtatgcaagaaaatcatctttctaatgagctttgtgggcaactgtgggacattcacaagaggctaccgagccatggttctggttctggatgtcgagttcctctatcatttgttgtatctggtgatctgtgccatggggctctttgtccatgtattcttctacagtctgctgcttttagatttagtgtacagagaagagtctttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagttgtcggaattaaaggatcagatgacagaacaaaggaagcagaaacaaagaatgggtcttcttggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagtccg

SEQ ID NO: 192 - DNA, 846 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcagaaggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgtgaacttctaatttcatatcaagagttgtaatcacatttatttcaataaatatgtgagttcctgc

SEQ ID NO: 193 - DNA, 494 bp, Homo sapiens
ttgaatttaggtgacactatagaagagctatgacgtcgcatgcacgcgtacgtaagcttggatcctctagagcggccgcctactactactaaattcgcggccgcgtcgacttttttttttttttggctttttttttcctttttgtggagaacggggtctcactatattgcccgggctggtcttgaactgctgggcttacgctatcttcttgcctctgcctctctaagtgctgggattagaggcgtgagccactatgcctggcagttatgagactttacaatcctacagtcaactgtccgcagatatctttgcttatgtcaaggactgagccttctccttttgttgtactctgtgtaatccctcggagatgactctgtacacagtgaagctcgcgctcttcatcctgagttgaaagcaatgagtgatacctttgcagcctggcattgagccaggtgagagacgttcaaagccaggtcatcatataagtagcgtcg

SEQ ID NO: 194 - DNA, 509 bp, Homo sapiens
ttttttttttttttttttttttcaacggggtcttcctgtagtgacccctgagttaaagtatttattttcacgctgcaactgctgatcactttacagagacatatcatgctgtagctctgcatggagctgaagacaaaagcaacatttttattaatgttataattattataattatctttaacaaagctattaaataacctgtacaaagcccaaaccggtcctagcgaaaacccgagcactgtttcaaatctcccaagttcctttctattcagttcagcagcatttcctatatacaaggccagcccagggtggtcccccgaaactgtaggtctccctgacggtgggaacggtttagagtttggaaccgccctggcgtacggcagagctcccaattacaatccaaatgccccagccccaaccctacctccccgctcctgggaactgggtccctatgtccgaaggcagcggaagttggaagcctggctccattttgggaggcaggcaacgga

SEQ ID NO: 195 - DNA, 473 bp, Homo sapiens
ttttttttttttttttttttttgattataatttggtttatttctctttgactctctataaaaaaagaactggaaaaactattgtattaactgatttcaagtatagaagccatcttgaagaaaagacagttacttgagctcttgaatttatcagatgatgaaaagtgcagagaagaaacaataaatacaaatgttcctagtcactgtgtaaatcacatttaaatttgatggggttttctaagaataacactaagtttataagtattaacaatcttttaaatctgaaaaatgttttataaatatgggtattagttaatatttgttatataaagtgttgaattattaactatttctttaaaacaggacagatggcctaattaaatgacaaaagaaaacaacatctttttacattttcccactgatactgtacatatgtaatataaagtacacattctggaagaaaaaaaggagtga

SEQ ID NO: 196 - DNA, 2657 bp, Homo sapiens
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctgccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggcagaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaacgtcacgcccataggctacatccccaaggaggatgccctgaacctgaaaggcctggggcacatcaacatgatggagcttttcagcatctccaaggaattctgggacaaggaggtggaagacatcgagaagtatctggtggatcaagtcaatgccgacctcccctgtgaaatcgagagagagatccttgccttgaagcaaagaataagccagatgtaatcagggcctgagaataagccagatgtaatcagggcctgagtgctttacctttaaaatcattaaattaaaatccataaggtgcagtaggagcaagagagggcaagtgttcccaaattgacgccacctaataatcatcaccacaccgggagcagatctgaaggcacactttgatttttttaaggataagaaccacagaacactgggtagtagctaatgaaattgagaagggaaatcttagcatgcctccaaaaattcacatccaatgcatactttgttcaaatttaaggttactcaggcattgatcttttcagtgttttttcacttagctatgtggattagctagaatgcacaccaaaaagatacttgagctgtatatatatatgtgtgtgtgtgtgtgtgtgtgtgtgtgtgtgcatgtatgtgcacatgtgtctgtgtgatatttggtatgtgtatttgtatgtactgttattcaaaatatatttaatacctttggaaaatcttgggcaagatgacctactagttttccttgaaaaaaagttgctttgttattaatattgtgcttaaattatttttatacaccattgttccttacctttacataattgcaatatttcccccttactacttcttggaaaaaaattagaaaatgaagtttatagaaaag

SEQ ID NO: 197 - DNA, 873 bp, Homo sapiens
atggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttag

SEQ ID NO: 198 - DNA, 502 bp, Homo sapiens
ttttttggagttgtaatggctagaaatcttagacattcttattcagtagatctggggagaggtctcaagatgcccttggtgcttctgattggccaggctcctggccaccgacctctgagtgagtggagtggtggggccgggacggggtgagggcagagtgggaggctggctgcagctgttgcagccttccggcctgagggagctaggatgcctcgcctcttcctttccctccccacttcccctttcccccatggggtcgctaatggcattgccgcagtccaagggctccttcctgttactgactcactgtgtgaatggggggtctgcagcaggatggagggagtagagctgtagggtgggctggggcccccttccctatccggctgctggagccctgtgctctgctcacctgtaccgctcaccacatgagaagtggccccttgccttcttacccatctctgtgacttgattaactctgctcccagtgagaagttagtgggtc

SEQ ID NO: 199 - DNA, 2312 bp, Homo sapiens
tcattaataagacaaactactggtgaaaaaaagaaccctttccgatattttagtaaacaagaattaagagagctctttacaatcgaggatcttcagaactctgtaacccagctgcagcttcagtctttgcatgctgctcagaggaaatctgatataaaactagatgaacatattgcctacctgcagtctttggggatagctggaatctcagaccatgatttgatgtacacatgtgatctgtctgttaaagaagagcttgatgtggtagaagaatctcactatattcaacaaagggttcagaaagctcaattcctcgttgaattcgagtctcaaaataaagagttcctgatggaacaacaaagaactagaaatgagggggcctggctaagagaacctgtatttccttcttcaacaaagaagaaatgccctaaattgaataaaccacagcctcagccttcacctcttctaagtactcatcatactcaggaagaagatatcagttccaaaatggcaagtgtagtcattgatgatctgcccaaagagggtgagaaacaagatctctccagtataaaggtgaatgttaccaccttgcaagatgggtaaggtacaggtagtgctgactctataactactttaccaaaggggtttggaagtgtagaagaactttgtactaactcttcattgggaatggaaaaaagctttgcaactaaaaatgaagctgtacaaaaagagacattacaagaggggcctaagcaggaggcactgcaagaggatcctctggaaagttttaattatgtacttagcaaatcaaccaaagctgatattgggccaaatttagatcaactaaaggatgatgagattttacgtcattgcaatccttggcccattatttccataacaaatgaaagtcaaaatgcagaatcaaatgtatccattattgaaatagctgatgacctttcagcatcccatagtgcactgcaggatgctcaagcaagtgaggccaagttggaagaggaaccttcagcatcttcaccacagtatgcatgtgatttcaatcttttcttggaagactcagcagacaacagacaaaatttttccagtcagtctttagagcatgttgagaaagaaaatagcttgtgtggctctgcacctaattccaaagcagggtttgtgcatagcaaaacatgtctcagttgggagttttctgagaaagacgatgaaccagaagaagtagtagttaaagcaaaaatcagaagtaaagctagaaggattgtttcagatggcgaagatgaagatgattcttttaaagatacctcaagcataaatccattcaacacatctctctttcaattctcatctgtgaaacaatttgatgcttcaactcccaaaaatgacatcagtccaccaggaaggttcttttcatctcaaatacccagtagtgtaaataagtctatgaactctagaagatctctggcttctaggaggtctcttattaatatggttttagaccacgtggaggacatggaggaaagacttgacgacagcagtgaagcaaagggtcctgaagattatccagaagaaggggtggaggaaagcagtggcgaagcctccaagtatacagaagaggatccttccggagaaacactgtcttcagaaaacaagtccagctggttaatgacgtctaagcctagtgctctagctcaagagacctctcttggtgcccctgagcctttgtctggtgaacagttggttggttctccccaggataaggcggcagaggctacaaatgactatgagactcttgtaaagcgtggaaaagaactaaaagagtgtggaaaaatccaggaggccctaaactgcttagttaaagcgcttgacataaaaagtgcagatcctgaagttatgctcttgactttaagtttgtataagcaacttaataacaattgagaatgtaacctgtttattgtattttaaagtgaaactgaatatgagggaatttttgttcccataattggattctttgggaacatgaagcattcaggcttaaggcaagaaagatctcaaaaagcaacttctgccctgcaacgccccccactccatagtctggtattctgagcactagcttaatatttcttcacttgaatattcttatattttaggcatattctataaatttaactgtgttgtttcttggaaagttttgtaaaattattctggtcattcttaattttactctgaaagtgatcatctttgtatataacagttcagataagaaaattaaagttacttttctcaaaaaaaaaaaaaaaaaa

SEQ ID NO: 200 - DNA, 3171 bp, Homo sapiens
gaattcgcggccgcgtcgaccagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcctttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctggaaaaaaaaaaaaaaaaaaaaaa

SEQ ID NO: 201 - DNA, 3845 bp, Homo sapiens
cgctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctccaaaaaaa

SEQ ID NO: 202 - DNA, 1126 bp, Homo sapiens
gccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagatgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccaaaaaaaaaaaaaaaaaaaa

SEQ ID NO: 203 - DNA, 100097 bp, Homo sapiens
gatctcggctcactgcaagctccgcctcccaggttgacgccattctcctgcctcagcctcctgagtagctgggactacaggcgcccgccaccacgcccggctaattttttgtatttttagtgtagacggggtttcaccatgttagccaggatagtctcgatctcctgacctcgtgatccacccgcctcggcctcccaaagtgctgggattacaggcgtgagccaccacgcctggcctacgcccgggtaacttttgtatttttttagtagacacggggtttcaccatgttggccagactgctctcaaactcctgacctcaggtgatccacctgccctggcctcccaaagtgatgggattacaggcatgagccactgcacccggcctgacttcacaatattaattggacataaaataggagaaaaacaaggggaaaaactgggacaacaggaagatctgttgtcctagttttggaacaacaaaaatttggaaaatgagagcgcaggcaaagagtggagagtaaggggaaatgacaacagagggagcatggggagaggatggaagaaacagacacaaggggaatgagcagagggaagacaacaaatcacagcagaagggaagggatgagaagcaggagccttcagaggtcacaggtctactactggatcacctgataattaattggaaggtttatgtatacatttaaaacatcatgttccatttctaacattattcataagttcaaaaaaagaacaggtctttcatagaaaatgattagtggtattagcagaaagaaaggaatagtaaatatttctccaattctgtgagttttctatcaacaagctgatgattaacaaacaagaaactttgttttgtttttgtttttgagacagggtcttgttctgtcagccaggctggagtacagtggcatgagcacagctcactgcagcctcgatctcctgggctcaagtgatcctcctgcctcagcctcccaagtagctgggactataggcctgcaccaccccgcctggctaatttttaaatttttttgtagagacagtggtcttgctatattgcccatgctggtcctgaactcctggcttcaagcgatcctcttgccacagcctcctcgagtgttgggattacaggtgtgagccattgtgcctggtcaaggaacttgttttgaacctggcaggctacaggaatcttcagacacaggaaatagtttctatccaacaaggagaggaacacagagctgacagtgctcaagtaacagaggagtaggtggaaaaaagtggttacgacattagtaaaaataattaaacccttcactgactgacacagaataactcagaacaaaaaagaaacagaaaacaatgctggagaccaggtgcagtggctcactcctgttaaatcccagaactccaggaagtggagacaggtggatcactttagcccaagggttttgagaccagcctaggcaacatggcgaaacctcttctctacagaacatgtaaaaattagctgggcatggtgatgcatgcctgtagtcccagctacttgggaggctgaggtgggaggattgcttgagcctgagaggtcgaggctgcagtgagctgtgatcgcagcactgcatgccagcctgggaaacagcaagaccctgtctcaaaaaaaaaaaaaaaaaaaaaaaatcatctagtacaaagagcaagtaccaagagaaattataagccccatttatgcctgatcaaaaatagaacttgatgtttcattagtaacatccttcatgttcacgctttattcacactccctttgccctctccaggtagaagcttgctgtggacctccctattgctgtactcacgtgagggcttctttgcagcactgtcctgaggggttaagatccagcagagacaaatggaaatgtctgccaacagtgtcaccttgtcttatctggctgatgcctcttgaacttcctcgttcttactacacatccaggacccagagctcttcatagaaaatcaccattaagtttggaagctgggaatcctcatcacaaggacagtccaggtgcaagttcgtggaattacacaaagcagtgtattggaatcacactaatcacacaggatggaagaagacagaaagccaacagaaggatgcttggtagtttcgggaatgtggtaccgggacaatgggttgggattagacggatgatcagttcgcctggtcatctctgctaggaaagatattcccccgacagaggcacctaaattgtaatccatgggaacggagcagaactgcctcccaggcaactgagtggctgaagaggtgaggacttggaactcaattatttctgattttaaagagcaaaaactacttagcaataaaaaacccacctggaatcagggtcacagtaccatgcttctggagttaaatgaacacaaacattctcactttccatctggtctacaaaaggggataggtagtctctaactcctcaacactcaattgaacacatcagagatcccacagctaacacacagagagacaaaaccatcttatcagacagtaagcctgcatccgtcttaccctggggaaatgcgctcccataattctcctgcctgttgtccctactgagattcctccgagccagattctgacatccccattcctccagaatgagggacacagccatgtcctcgatcttcaccattgcctaaaataacacgagacaaacagtcatttccccccaaactcagggacaatcccattgctcaaacctggagtcaggaagagaggtggctgcaaagctacaggacgctgggaagaaaagggtggccagaacctgggggtggaggggagtttgtggtagaaagatgctaaaaggagaggacagggttggggcttctttgagagcaggggcatccagagtggcctgtggagataatgaagagagctcaggaacagaggcagacactgaggactcaggagagcagaggggccacagctcacctgggaatccgctgtgaatagtgcagatgccatcgcctggtctctgggactaccctcatgagggggtgcaggaatgtgggcagcaggaagagctgggggaggagaaagggtctgtgagtaaatcagctccgctctgagccttgctcaaagaagggctcggggcatgttccttcctgcaccagcatgttcactgttcagtgtttaggtcccaaatacagaattccagacaacacaaacgagagaacacagggcctcagttttcccaagacctctactcttgagcaggagtcataaaagggtcctaatcacctggtccaacccttttattttaaagaaggggaaacttgagtccctgagactgcaaatgacttccctaatgtcacattcccagtggcagagccaggatggggacccaggttcctattctcagctataaaagtgggtaccttcagcccatagctcaagtctggctcctaatttcctccagtccaaggaacgataccaggatatgagaatcccatttatgcctacacttgtggaaaacacaacacagctttaaaatctttagtggcaggtgaggcgggaggattgcttgagctcaaggggtcgaggctgcagtgagctatgatcacgcactccagcctggatgatagagtgagaccccgtctcaatgaaatccagaaaaacaacaacaaaaaaaacactttagtagcaatatccagaaaggcagggaagtaaggaggtctccttagctctgggtaagtttttttttttttttttttttttttgagacagagttttgctcttgttgcccaggctggagtgcaatggtgcgatcttagctcatcgcaactttcggctcccgggttcaagtgattctcctgcctcagcctccagagtagctgggattacaggcatgagccaccacgcccagctaattttgtatttttagtagaggcggggtttctccatgttggtcaggctggtctcgaactcctgacctcaggtgatctgcccgcctcggcctcccaaagctctgggattacaagtgttagccactgtgtccggccacctctggctaagtttttgccagtttttgtccctctacttttctccctcacttggccacaataaatactgttttttttttttttttttgataagatgtatgcatggttcaaatgctgagacaaaagttggggctgacacacaacaaaagacatgcataacattatcacgtgatcacaataactgtgatgcataacaattatgaaaattttaaattgtgcaatttaaccccctccccatctcttgccaagtactattagatttggaaatgttactggtagacagatgatgttagtgagatacaaggatatttgagaaatgaatttgaaactgaatgaccaaaccttgtacctatttcaaacctttatacaacaataagataggctctctgtcacccaggttggaatgcagtgctcaaacatgtctcactgcagccttgacctcccaggctcaagtgatcctcccaccttggtctccccaaatgctaggattacaggtgtgagccactgtacccaagtactttttttttttttggagatggagtctcgctctatcacccaggctggtgtgcatggcgcgatctcggctcactgcaacctcccctcctgggttcaagtgattctgctgcctcagcctcccaaatagctgggactacaggtgcctgccaccacgctcagctagtttttgtatttttagtagagacggggtttcaccatgttggccaggatgatctcgatctcttgaccttatgatctggccacctcagcctcccaaagtgctgggattacaggcgtgagtcactgcgcccagccccaagtacttaattttttaaacttctgagagtaaggaaacactctggaaaacaaataagaaagaggaaattgagaataaatgtacatgtctcaatttatttaagaactatttactaaagagcaactgtgtgtgccaggatctttgaaactgttactctggcaacctaaactctataatctagtgcttaagaccatgaatatcctctccagtttcctaaggtcgccctgtgacttctgcttgtagagtgtggagaaaccttacaagaacatcaacagtagtggagttaaacatcacggtgcaccggtgttttttttttttttttttgagacagcatctccctctgttgcccaggctggagtgcagtggcgcaatctcggctcactgcaagctccgcctcccgggttcacgccattctcctgcctcagcctcctgagtagctgggactacaggcacccgccaccatgcctggctaattttttgtatttttaggagagacggggtttcaccgttagccaggatggtctcaatctcctgaccttgtgatcctcctgcctcggcttcccaaagtgctggaattacaggcgtgagccaccacgcctggccacggtgcaccagtttacacagctttctctagcacatacctgctggctgtcctccaggatgcacggaagagaggatgcatccttaagctccatgtctaatattccttaaatgtcatcaccaataaacacactggttaaggaatgtgcctcgaccaattcttttttttttttttttgagatgagtgttgctctgtcgcccaggctggagtgcagaggagccatcttggtttgctgcaacctccacctcccgggttcaagcgttcttgtgtctcagcctcctgagtagctgcgattacaggtgtacaccaccacaaccaactaatttttgtatttttagtacagacggcgtttcgccatgttggccaggctggtcttgaactcctgacctcaagtgatttgcccaccttcgcctcccaaagtgccaggattagaggcgtgggccactgcgcctggcctttttttttcttttttgagatggagttttgctctgttgcctagcttggagggtgtatgaatttttaacaaaaaaagcttaaaaagtataaaataaaaatttttttaactagaaaaacccctatagaatagggggataaaaaatgtttttgtatagctgtgcaacatgtttgtcttttgagttatgttattacaacagtcaaaaagttaaaaaaatcaaaaagttcataaagtaaaaaagttacagtaagctaatttattatttgtatttatttatttattttttttttctgagacagagtctcactctgtcacccaggctggagtgcagtggtgcaatcttggctcaccacaacctctgcctacaggttcaagcaattcttgtgcctcagcctcctgagtaactggaattacaggcatgcaccaccacgcctggctaatttttttattttgtagagacagtgtttcactatgttggccaaaccagtctgagactcctggcctcaagtaatccgcccaccttggactcccgaagtgctgggattaagccatgagccaccatgcctggctgatttattattgaagaaacaaaaattttaaagataaatttagtgtagcctaagtgtacagtgtttctacagtctatggtagagtagtgtcctaggctttcacattcactcaccactcactcactgactcatccagagcaacttccggtcctgcaagctccagtcatggttaagtgttccatacaggtgtactttttttttttttttttttttttttgagatgagtttcactcttgttgctcaggctggagtgcgatggcatgacaatggtgcgattttggctcaccgcaacctctgctgcctgagttcaagcaattctcctgcctcagcctcctgagtagctgggattataggcacctgccaccaggcctggctaattttgtatttttagtaaagacggggtttctccacgttggtcaggctgatctcgaactcctgacctcaggtgatctgcctgccttggcctcctaaagtgctgggattataggtgtgagccactgcgctcagccaatttttgtattttcagtagagaccgggttttaacatgttggccaggctggtcacaaactcctaacctcaagtgatccacccaccttggcctcccaaagtgctgggattacaggcgtgagccactgtgcctgggctaaaaatcttttatactctgtttttactttttcgatgtttagatacacaaatacttaccactgtgttacaattccctacagtgtttagtacagtaacatactgtacagctttgtagcgtaggtgtggagaaggctagaccatctaggtttgtataagtatactttatgatgttcgcacaacaaaatcacttaacattgcacttaccataacttatccctgccattaagtgataaatgtacttttagcattccttgtctttacattctaagcacatactttgattttaaaactggataaatgtattacatatttccgtcaaaagagaaaaaacaagtaacatgactttttatttatatgactgtgaactgatcttttttcgtgttcctcaactcccctcaaaagttcttccattcttttcccattgtttgaaatttctgaaaataacctagaaaagactgatgctatagtttttttttttttttttggaaacagactctctgtcacccaggctgcagtgcagtgattatttttatatattttaaataaaatggacctttaaaaaagatttatgatccttttgaagataattcatgacatactaaaatgttttaaaacctaggctgaaaataatgacatctgttcccaatactttcctattaaaaatgtgctggacatctggaatgctgataattcaataaataatgcctaccaggttcattacgcatagttcatttgccttcgtagtaacatttaactcctgagattggtctgtaagttgtattttccccaatatttggtaataatgacaacaatgtagaataactaaaaacaaaaaacaagcatgcagctttttttcatttttttttaaatttttaattaattcttttttttttttttttttttttaagacagtctcgctctgtcaccaaggctagagcacagtggtacgatctcggcttactgcaacctccacctcctgggttcaagtgattctcctgcctcagcctcccgagtagctgggattacaggaatgtgccaccatgcctggctaattttcatatttttagtagagacaaggtttcaccatgttggccaggctggtctcaaactcctgacctcaagtgatctgcccgcctcagcctcccaaagtgctgggattacaggtgtgagctaccgtgccgagcctaattcttttctgtaagtagcttttgagacagggtccttgctgtgttgcccaggttggagtagtggcatgattacagctcactgcagcctcaacctcctgggctcaagcaatcctcccacctcagcctcctgcgtagctggaatcacaggtgtgcgccactatacctggctaatttttctattttttgtagagatggggtctcgctacgttgcccaggactaacatgcttcttcatcacaggcactcagcagcacaaagactctcgtcctgaatcatttcccttcccctaaatgaaaccttgcttcttacctcgtgactgtaagaggcggggtttccgagacgaatgtttgaagtgggactgggtggcctcgtgatgaaggtcaaagctcgaggactcctgaactggatccagaggcaccatcccccttgcgagcatctcaggtccatgaacttgacctgggacctgaagacagacaggttgggcttgtgggtaaatcactttgtaaatgggaattaaaatatttaaaaacagaccatgagtatgccagtggatgcaggaagaaagccagaacatttttaagacagagtaaccacctaataacctaaagcctgccaatacttctcctggctccagtttcaacgtctgtgccctgctcacacataataggtttcacctctttttacctgttgtcctgataaatcaagctccaagtcttctagaagggtcacggcctcctctccactatcggggcggtattcctgcagccagacctggagctccttgggcaggatggaaagaaactgctctagcaccagaagctccaggatctgttccttggtgtttatttctggccgcagccactgatgacaaagttccttcagccgactgagagcctctcggggcccaaaagtgttctggtaacagaagcgcctgaagcgttggcggaatatctctgggtctggaggaggcgtgtcctgtagggtggaatcctgcccccacatgtggtcttcctcatcttcctcttccaccttcactattacgataccatccttctcctgtgcagcctgtggggacagacccgtggcttcccgtgattcagcagtcatcattcaggctccaggaactgacttgatccaaacagggtctgtgctcacctttatgtcctgggaggttttatgatgtgtttctttactattcctgaagtataaaaaaaaagtcattagtacgtacctttacaaaaagtgatctgtgctgctaacactttataggaggcagcacatcgaggcactatcagaacgctcctgaggccgggggtggtggctcacgcctgtaatctcagcactttgggaggccgaggcaggccaatcgcctgcggtcaggagttcaagaccagcctggccaacatggtgaaaccccgtctctactaaaaatacaaaagtcagcagggcatggtggcaggcgcctgtaatcccagctactcggaaagctgaggcaggagaaacgcttgaacccaggaggtggaggttgtagtgagccgagattacgccactgcacttcctacctgggagacaagaagttaaactccgtcaaaaaaaaaaaaatcctgacaaatcgaggaaaaaactgtacaatctccactgtcacttcatatatcaagatttgcaaacagaaacctcaaacaggccgactccaccctcagggtgtttgcttggagtcagagtgatttacctgcaggttgacagcaggttacgaaatggagcattaacagtgcccagcccagagagctgaatgttagcagagtgccaggtgccaggcttaaagcagtacacgcaccatcttcttttgtccctacaacagccctagcaggtcggccaaactgttaagtgctgttttacaaatgacataactgagggttaggtttgctcagtagtaggtggctgcctactggagtcaatattcaaccaaatttgaagccctgggacctacttttgtaccatccagctacttttgctatttttatgagtgacttgggcagttaaattgtggtttccaaagtacaagatgatccgcaaaggatacagaaagaaaataattggaatgtctgtatcttaaaagagagagaaattaagctataaattgacactaatacacttacttagtctgtgctgacctgtcacaggtgttgttcattttagacattgtgatgtagactggtttatctgagaccagttatgtgaaataatggatttctaaatctagctttggctgggcgcagtggctcatgcctataatcccaaaactttgggaggccaaggcgtgcggatcacgaggtcaggagatcgggaccatcctggtcaacatggtgaaaccctgtctctactaaaaatagaaaaattagctgggcgcggtggcgggcacctgtagtcccagctacttgggaggctgaggaaggagaatcacttgaacccaggaggcggaggttgcagtgagccgagatcgcgccactgcactccatcctggccacagagcgagactctgtcataaaagagacaagcagctttaaagattcttgtggccagatatggtagctcatgcctataattccagccctttgggaggatgaggcaggaggatgcttgaagccagaagtttgagaccagcctgggcaacatagcaagaccctgtccctatgaaaaagaaaaaaattagctgggcatggggactgtgtctgcagtcacagctactcaggaggctaaggtgggaggattgcatgaaaccagaagtttgaggctgcagtcagctacgatcacgccactgcattccagcctgggtgacagagcaaagccctatcaggaaaaggaaaaaaaaaaaaaaaaagattcttatagagaaactgcaattacaggacacactaataatataaacagatgtgaacaagaagaaaatggcacagatgaagcttctatctagagtaaggttttagccacattaggaggtaaaaaccaatgtcagtctaaatcaaagaaaaagtcaccaatgagtaatcagcttctttaaagaaagtgtgaagaaagggcaattacaggaacagctgtatgaaatggttccattgttatgtaatttaactgccaaaaatgatgtcaagtatccaggaaaaacccatctatgttcacattttagaaacttggggctgggtgaggtggctcatgcctgtaataccagcactttgggaggctgaggcagggagcagggggccacctgcggtcaggagttcaagaccagcttggccatcatcgtgaaaccccgtctctactaaaaatacaaaaaattagctgggcatggtagcaggcgcctgtaatcccagctatttgggagactgaggcaggagaatcgcttgaacccaggaggctgaggttgcagtgaactgagatcacgccattgcactccagcctgggtaacaaagtgagactccatctcaaaaaaaaaaaaaaaaaaaaaaggaaaaaaaaaagaaacttggaaatattttctaacctgtttaaaaatctttcaaatgaagaatttcaggtgggtcttaagcctatttgttaaaaatataaaatgccaccacctgattagtttgtaagactataccctgcatttcaacaacaaaaattcagcatggttgataggttggatcaatcacaagttactaagcagaactgacactgtgattcttccatctgaagctacaaatctttctgaatttattcttttcacctctacagccatcaaaactaagcatcaaattgaagttttagaaacagaccattaaactgctttatcatgatgggttaaaccgagttttaaactagcaaaagcatttttagttttatggctctcactaaacatattcttaattttggtgaaaaagggatcatgtacatataacagcacaaaaattatatatacatatatattgaaacggagtcttgctctatcgcccaggctggagtgcaatggcatgatctcagctcactgcaacatccgcctctcgggttcaagtaattctcctgcctcagcctcctgagtagctgggattacaggccatacttattttttttaatctagttccatgaagtccagcttcctttctttggttccctgccttcattttctcccttctctcccacaatccacctttcagattattctttctaaaactctacagccttgcagttaatactttccagtgcctggtcccaattttccctcaagcttcttttcccatcaatccccccataaaccttccctatgcaacaaaagccctctcatcagtatttcctatatatgccttgtattttgactgccatcctttcctcacatcacactccatgcctgggacttccccccgcagtcctctctgccttttcaaatcctacttaacctttaaagctagctaaaacgcgacttgcctcttatcactgttcaagaaccctctcataactataacagtaagagccaatgtttactgagtgctttctaggtaccgggtatttaagcattttcacttgaccacataacaatcttagcaggtagctacacttatcatctcactgtataaagaactgagaggctgagcgcagcggctcatgcctgtcatcccagcactttgggaggccaaggcagatagataacctgaggtcaggagttcgagaccagcctggataacatggcaaaaccccatctctactaaaaatacaaaaattagccaggtgtggtggtgcaatgcctgtagtcccagctactcgggaggctgaggcaggagagttgcttcaacctgggaggcggaggctgcagtgagctgagattacaccactgcactccagtctgggcaacagagtgagactccatctcaaaaaaaaacaaaagaagaactgagatatactgccattaaataacttactcaaggtcacacagcaagtatatggtagaggcagaatttgaaataaaagtgattccccaatgtaaactctttaaccattatacaaaatttatcttgtacctgacatgtggggtatacagatcctaaaatgaaggcctatgaacgtgacaatgaagaatcaatcagggccaggcacggtagctcacgcctgtaatcccagcactttgggatgccaaggagggtcgatcacctgagctgaggagctcgggaccagcctggccaacatgacgaaaccccgtctctactaaaaatacaaaaattagctggatgtgtggcacatacctgtaatctcagctactcgggaggctgaggcaggagaatcacttgaacctgggaggtggagggtgcagtgagctgagaacgcgccactgcactccagcctgggtgacagagagagactccttctcaaagagaaaaaaaaatcactcaggaacgggccttatctaccacccagttttcactggagggtcactatgtgactgaagcccttcctgggaaagggaggagacacagcagaagattcaagtggggactgtctacaacataaccaggtgggatcttcaaacatggtaactgagcagaactagtgtgatagcgagcccagccaccagaaatccctacttttgtgaaagttttatcctgccttagctattgagcaggacacttcttgggtcagtgcgaagatgcgactctaaggaggaaatgagtccagggggaaatagacacagacatgggcacattccctctgcccacaactgggacagatcctcctcctcaccttcagtatctctctgctcctactctggggtgcagggaaaagccatcacagcagtggaaaggctgggttttatttgaggtttcccagatgatctgagcacatactcttctgtctctaaaggccctaatactcttcaccaaacatttgctaggtaatttctcatgatgcgccgggcgcagtggctcatgcctgtaatcctagcactttgggaggctgaggtgggcggatcacgaggtgaggagatcgagaccatcctggtaacacgatgaaaccccgtctctactaaaaatataaaaaattagctgggtgtggtggcgggcgcctgtagtcccagctacttgggaggctgaggcaggagaatggcgtgaacccgggaggctgcgattgcgccactgcactccagcctgggtgacagagcgagactctgtctcaaaaaaaaaaaaaaaatttctcatgatgtttctttctctgtaatttttcttgccttcttcctcaactagattattaagagcagtcctctttgtactccttagaccacttagcatgattccttgcaagcctcagtttcaaaaatacacttgactgaattgacaacgttactattttttaaaagcccgatcattctacattcaatgttgcactcaaatttgttccatggactagttggatgagtttcaggttagcattaaagctgctccaccccttactagttgacggccttaggcaagtcaacaagttaacctctctatgcgtcagtttcctcatctgtataatgggaataaaaatcagcatttgtcccatagagttgccgtgaggattaaatgaggtaatagatataaagcacttaaaatagtgcctggcatttagtaggcactacagaaatgtcttaatttttttcaataagcttaaaagatgtaactgtacattccaattttcagcctgcttagaagattaagcaatgggacaactcctgtaatagtgaaagctgcacaggcaataactgaattctagtctcccacaagtaagtggcacatccctgagagaggtatttaacttctctggcattttgtatctttatcagtcaaatgggggtagggtgggggttccagatagtaggaaactacctctgggtgaatatgggctgaaaaacatactgacataccatccactttaaataaaattacctccagcagctaaggatacctcagttctcacctaggataaacagaaatgattttcttaaacaacggcttgaagttacaagctcaaaggctgtgttccaaacagcccagtatttttccagggcatagtcttgaaaatgtaaacaaaggctgggcacacagtggctcacgcccgtaatcccagcactttgggaggctgaggttggcggactgcctgagatcaggcgttcgagaccagcctggccaacatggcgaaactctgtctctactaaaaatacaaaaatcagccaagccttgggacacatgcctgtagtcccagctattcgggaggcggaggcaggaggatcgcttgaactcgggaggcagaggttgcagtaagccgagatcgcaccactgcactccagcctgggcgacagagcaagactctgtctcaaaaaaaaaaaaatttttttttaaataaattgccctttgccctttacactcatttttttaaagagcaatcaaatgttttaatatgaaaaagctaccttaaaagacagctagctattcaaagaatattgatactcccacagaatgaaaatgttagatttaatatgctattcatctgtattttaaatgcttttaaatcgagaatgagcaaaagactaagtagctagcttcctcgtttgtattttaagagtggtgaaaactgcctgaaataataaacaagaatcttatatgttaattcagagaagatacaaacctggatacacattctggggcaaatcaccatggtttcctatgtaaaacagcgatttctccacatttgttcagcatatatactaacagtgctttgctgatgtggttacaatgaattctccacaattcaattcaacaagtatttattgaccgcctccaatccgcctagcactggcccgtacaataaatgctttctttggtcccaggccatggaacagccactctctataatgaaagtatcttactgtgtacagggggcactgcaggaaagggaggggagggatggaggagtgtcaagctaaactgtagttaattcttcaattacattgaccaaatcatttcgaagtcggaagggccttttgagaaaatccagttagtttttattgatgacgaaattaagacttggtgagtgtctcgtcttatccaaggtcactcagctaatcagtctcctagtgacacagtgcaatttccacaaattcccttcacttctcaccccactccatgtcaaacagagcaactatccagaattgaaaaatccacctaacgtcccggacagctcttttccaaagccttcaaagcattccatcaagctgaaagagtggggtgtatataatctctactagatcccaatcacctatttatccactatgactaggcttcaaatactctttaatcaccgctcagtgatgagggtgggagaaggaaaggcaggtctggaaacgtatgcggcacctcaaaatgtgtccatctctcatccttccgctcatttcacctcgaggtcccgaaggaaccggggggggaaaaagacacctcaccggaatcaaagcaaatggcgactaagggagagcagaaaaatcaagaccggggtcggttcgctcgcgaccccgtttgcagaaacgtcaaagggcgatgacgacactgcgggagaggggcccacagacggcttctccccgggtctccgggcaccctcagccactgaaaccctcgccccctccccgcctgatcctgggggtggggcggggacgtctcccaggaagaacggcgctttctacggccgggcccggccaggaggcaggggcatggactctcttcgcacaacagcggggccgcctggagggggtcccagggccgcagctgcggagcccaccctcgcgcacacacccttgcggccccgccctcccaccccagaggccggccccaagtctcaccgtgagccccgggagcggcctgggggcgctgggcgagaaaggggagctgactctggggctcaggccggccgaagggcaccgcacacggacttaggccctcccgacgcctcgacacagacacaatgagtcacaaaggccggaagcgtgtcaccacctcgtcttccgggaccgcgccgcgcttccgggtcctctctaggagcgcgggaggactttgcatctcggtttccgaatcgctggaccaggcgcctgcccttgagttttcaagcctccagcttggaggatcaggtcccagtccgcccctagttaatgcagggactaacgggagcaggtggtggggggtttcaggctttcccctactcaaactcaaacagactctccagctcagacaccagtccatgtgaaagttcgatttcacctgtctttttcatctcaggcagtccttgtagtaattatagttattatcaagcaatatagtacttggtaattgtatgtctgtggcaaaggaactgaaacaaggatgtagactgaggaagatcaaagtgaagccaagggtggctggtttcccaaagctgccacggtagcttctctcagggccctggagctatatggagtggtattttcaaatacttggcccgtggacaagggatgtctttccacaagcaagcatagttataaggttctgtgctttgctcatgtggcatatgctattatagccgtttaaaaggagttttcagagtaacaacagacacttttaccttcaaagtgctttcacaacctaccacagttacagccttcatctttgccttgcagggtaaggcacgcataagagggggccacgttgtgcaagggtgggggggactacaggctttaatggttgtgactttccactatgttccgagacaagttcatgggagaaactcagtagcttggttgcatgactcttactgcttggagagatttactttttttttttagatggagtctcgctctgtcacccagcctgcagtgcagtggcaccatcttggctcactgcaacctccacctcccaggttcaagcgattctcctgccttagcctcctgagtacctgggactacaggcgcacaccaccatgcctggttaatttttgtatttttggtagagaacagggtttcaccatattggccaggatggtctcgatctactgaccttgtgatccacccgcctcagcctcccaaagtgctggaattacaggcgtgagccaccgtgcccggccagatttactttttaaaaaatgtttgaaaactaaaaagcaatgacagggccagacacgatgactcaagcctgtaatcttagcacttcgggaggctgggacgggaggattcttgagcccaagagttggagaccagcctaagcaacgtaatgagaccctctctctacaaaaaatactaaaattagctgggtgcagggtagtgtgtgccagtggtcccagctgcttgggaggctgaggtagaaggatagattgagcccaggaggttgaggctgcagtgagctatgattgtgccattgcaccccagtctgggccacagagcaagatcccatctcaaaaaagaaaaaaagggccgggcacggtggctcatgcctgtaatcccagcagtttgggaggccaaggtgggtggatcacgaagtcaagagattgagatcatcctggcccatatggtgaaaccccgtctctactaaaaatacaaaaattagctgggcgtggtggcacacgcctatagtcccagctacttgggaggctgaggcaggagaatcgcttgaactccagaggcggaggctgcagtgagccgagatcgtgccactgctctccagcctggggacagagctagactctgtatccaaaaaagaagcaacaacagtatcattaaaggaaatttgcaaaatggagaaaaataattaccggtaatctctccaccctaacacaatccccatggctttagtttacctttttcctgttttcatatacaaataaatatttattgatattattttaaacactgttcaaaaccatagttgcagttgtattgaagaggaggctggtatcctggaagtatctgctacattcatatcatgtgaacactgttttttaaggaagagaaaatatatttactattcagtaagtggaaatagatcatcatcaaggtcttcatactcatcgtcttcacactgagtaagctgaggaggaagaggaagggttgctcttgctgtctcaggggtggcagaggcaggaagtgatccaccagcctcggcctcccaaagtgctaggattacaggtgtgagtcactgcacctggcctcttttctttctttttttttgagagagtttccctcagttgccatgttggagtgcaatggcgtgatctcagctcactgcaacctccgcctcctgggctcaagtgattctcatgcctcagcctcccaagtagctaggattacaggtgtgcactcaccatgcctggctaatttgtgtatttttagtagagatggggttttaccatgttggccatgctggtctcgaactcctggcctcaagtgatccacccacctcagcctctcaaagtgctgggattacaagtgtgagccaccgcgcctggcctcgacatctttgattacttcctaaggatggattccaagaaatgagattactggtcccacagatagtcagagggaatataggcaataacgtttgtaaccccagggttctagacctgtcagcaaacaagctcagctgacaagatcaggtggtatccacccaagagttttgaaaggactctaagatgaaagtgttgaaagaatcatgaaactaatgatttatgattacaaagagacattgtgcttaaaaattggctggctgccctgaacaaataaaagttcctgaagggcaccctagaaactgtggttgcctaagtttgacttctgtgttgtgaaagctggtggagtcaatgctgaaggggagcccgggtttgcggctgtgactgggtggctgcagctactcctgggagggagggtctcctgtccctccaacttggaaggagtgggggcttccatgtgttcccagctccctccagctctgtggagtgctgcgatcccagctatgcctcactcactgcagccagcatcatggcagtggccactccagatggggtgctgctgccaaggcgggcagatcacctgaggtcaggagctcgggaccagcctgaccaacacggagaaaccccgcctctactaaaaatacaaaattagctgggcatggtggtgcatgcctgtaatcccagctactcagtaggctgaggtaggagaatcgcttgaacccaggaggcagaggttgcggtgagccgagattgaaccattgcactccagcctgggcaataagagcgaaactctgtcttaaaaaaaacaaaacaaaacaaaaaaaacaaacccaagtcttatatctgattccaaaggtcccattttactgagtcttcttctttcttcttgacggagtttttgcttttgtcaccgaggctgggatcactgcaacctccgcctcccaggttcaagcgattctcctgcctcagcctcccacgtagctgggattaaaggcgtgtgccacctgcctgactagtttttgtatttgtagtagagatgggattttgccatgttggccaggctggtgtcgaactcctgacctccagcgatccgcccacctcggcctcccaaagtgttgggattataggcgtgagccaccgtgcccagcctgagttttctttactgtcggctagggctgtggctggggaacctgctgtgggaagggtactttcatctatgcttttcctcctccccttccctctccctggggtggcaggagtgagtgatctgactgttggagacaccttccctctctattttcctattggaagctgtggcttctctgttgtgttgagcaaagtggacggatagggagagggtcaaaaatctcttacttaactgactattctctcctgttggttgttgctcttccctcggtaacacagtgttccagctacttaagcagcaaaacaaattattcaacaatttcgtgggtgaaagcaatgacaacattgtttattttgctcctaaatcttccatttggtggagggatccacatggatggctcatctatgctccacctggctcctctggggggcctcaaaggttggaccatctgaaggctcgccagctcctaagattggtgattggtctggctgtcagcggagatcttagctggggcagtggatctgaacatgtgcaggtggtctcttcatgtgctctgggcttcctcacaggatggtggctggggtccaaggacaagtatccagagagagagagaggaggaaggaaggaaggaaggaaggaaagggaagggaagggaaggaaggaaggaaggaaggaaggaagagcaggtgagcgggcaggcaggtagggagggagggaggaaaggaaggaaggaaggcagggagggagggagggaaagaaggaaaggggagggagggaaagaaggaaagaaagggagggagggagggagtgaaggaaggaaggaaaggaaagggaagggaatggaagggagggaaggaaggaggtacgggaaggaaggaagtggagtgggtgacagagagacagaggggacaggtgaatgaaggccacatgtcctttataacctaatcttagaagcactcagcatccctttcactgcattcaatgccttgaggcagtcataaagtcacacctagtttcaggggaagggaaaatatgttcccccctcttttcttcttttttttatgacacggggtctcactcttgtcacccaggctggagtacaatcatgactcgctgcagcctcgacctcctgggctcaagtgatcctccaccctcatcttcccgtgtagctgggactacaggcatgagcaactatgcccggctaatgtttaaattttttttgtagagatgggggtttcactatgttgcccaggctggtctcaaactcctgggttcaagcaatccttccacctcagcctcttgagtagctgggagtacaggtgcacgccaccacacccagctaattttattttattttttgttagagatggggtctcactatgttgcctaagctggtcttaaactcctgggctaaagggatactcctgccttggcctcccaaagtgctggttttacaggcaccatgcctggcgatgccacctttttttttttttttgagactaagtctcacttttgtcgcccaggctagagcgcagtaacgcgatcttggctcactgcaacctccacctcccgggttcaagcaatcctcctgcctcagcctcctgagtagctgggattacaggtgcctgccactgtgcccggctaatttttgtatttttagtagagacggccatgttggccaggctggtcttgaactcctgacctcaggtgatctgcccaccttggcctcctaaagggctgggattacaggcgtgagccatggcacccagccagatgccaccttttgatgggaagtgatgtggttctggaattgcatgtgggaccaaaaacgctgccaaggtcacttttggaaaacacagtctaccgctactgtgcgtcagccacacaaacgttggcttgtggtgttcagggatgaaatcctcagggggccttgggggcctgcttactactcagtcccctgtcccagtcgatctgccttctgcccctagcagggcactgcacaacctccttttgaggagattcttgggtgggggcaccagttggacaactcaagtccagctacctgctcctgggtccatttgatctgtgacaaactcaggcacccttggccactcaaatggctggaacgtggacctcctgcggtgctcctgcccctccctggccaccttcccctcttagtgaatggaacgtggacctcctgtggtgctcctgcccctccctggccaccttcccctcttagtggctttgttgaatcacccgccacctgcctaggcacgagagtctcctatttaaaataatgctcaactagaggttgagggtttttttgtttttgtttttgtttttgagtcttgccctgtcgccaggctggagtgcagtggcgtgatctcggctcactgcaatttccgcctcctgggttcaagtgattctcctgcctcagcctcctgagtagctgggactacaggcctgtgcttccacacctagctaatttttgtatttttagtagagatggggtttcaccatgttggccaggatggtcttgatctcctgaccttgtgatctgcctgcctcggcctcccaaagtgctgggattacaggtgtgagccactgtgcctggccgaggatgaggttttttgtagatatggagtctccctggtgactgggattcctgcccgccctgccccctgctctttttttttttttttttgagatggagtctccctctgttgtgcaggctggagtgcagagtgcagtggtgcaatctcagctcactccaacctctgcttcccggttcaagtgattctcctgcctcagcctccccagtagctggggttacaggtgcatgccactacgcccagctaattttttgtattttcagtagatatgagacttctccatgttggccaggctggtcttgaactcctggcctcaagtgatctgcccacctcagcctcccaaagtgctgggatcacaggtgagagacaccgcacccagcctctgtccccaggttttgaagacattctcacttgtcttcatggtgagggggcaagggaaccagtcatggaggaggagagggaagcccccaccaataggcagaaggcaaagtcctttctctttggcttctaccaagtcctttctctctttcttgctgctttcgtccagacttgaggagcagaaaaactggctgagcaagcaaagctcgcgagcgtttctgcctgtcacgtaggtggcatctgggatctttgatgtgccgtgctgtgggctgggagtgtcctcctgaagtttttccttctttgttctcagctatggactccagccacggacaacagagtcctagcccacgtccagtcacatgactgcaaaagcacctgcgtctggatacggatgtttatgagaacattggtgcctaatcaaatcaaatcaaaacaaaccaaacagcccctagccttgtggcctcattcccaagtcagcccaagccatatccttcctagctatggtgtatagtagaggggcgcaggactcagatggtcttggttctcatcttgtctgtaccatgtactcttggtctagttacttgaacttttggagcctcagtttctctaagtgtaaaatgaggattcaaacagcacctacctcattgggatgtcatgaggcttgcatgatggagttgattcatgtaaatcagcagttgcagggtctggcattggacacagatgaatttagggctgtgggctgttgactgacccttgggcttgagtgacatgtgtggctccatcctgaagctcttttctagcagtgctgaggtgggaggagggacttgactctgcaggtggggcttggacagtggaccaaattgaggattagctaaaatggggccagggcagaagcagctttccataagacatgcccaccagagtgccatgtcagtttaccgttgccatggcaacacccgggagttaccacccctttccatggcaatgagctgacaacctagaagttactacctcttccctagtaatttctgcactaactgccccttaatctacacgtaattaaaagtaggtaggccaggtgtggtggctcacactcacacctgtaattccagcactttgggaggccgagataggtggatcacttgaggtcaggagttcgagaccagcctggccaacatggtgaaaccccatttctactaaaaatacaaaaatcagccgggtgtggtggtgcacgcctgcattcccagccactccggaggctgaggaatgagaatcggttaagcccaggaggcagacgttgcagtgagccaatatcgcgccactgtacactgtactccggcctgggcaacagagggagactctgtctcaaacaaaacaaaacaaaacaaaaccccaaaaaacaaaaaataatctatggtggtgctgaatgtagacagagaagagccagtgtggttgttcacgtctgtaatcccagctactcgggaggctgaggtgggaggagggcttgagcccaggagtttaagaccagcttgggcaacacagtgagactccatctcaaaaaaaaaacaaacaaacgaaacaaaaacaaaaacaaaaaaccagtgactgtagagagagaataaagtggttgggggaaaagaagtcagggcttcaaagtagaaagagtactgaaaacttataaatagcactttatcaggaaggtaatgaaagacctgaatgtaggttggttaaaagcatgatagcaggaagaatccaggcacattgaagatgaagacagaaaaaaacaaacaagccacatttagcaatttcagcaggaaatgaacacagatcctacggggaggcgaagttaacttgtaaatgagactctgtatgaaggtacctctatatacatttgcgtaaaactagtttaaaagctgcaaaacacagtcacacagttgttacagaaacgtgatcactaaagaataaattggggttggggcagggcatggtggctaacgcctgtgatcccagcattttgagaggctgaggcaggtggatcgcttgaggtcaggagttcgagaccagcctggccaacatggcgaaaccctgtctctactaaaatacaaaataattagccacgcgtggtggcacatgcctgtaatttcagctacttgggaggctgaggaacaagaatcacttgaaccccggaggaggagagattgtgccactgcgctttagcctgggcaacagagtgagactctgtctcaaaataaataaaatacaggctgggcgcagtggcccatgcctgtaattgcagcactttgggaggccaaggtgggtggatcacttgaggtcaggagttcgagaccaggttggttaacatggtgaaaccctctctctactaaaaatattttaaaaattagccaggtgtggtggtgcgcacctgtaatcccagttactcaggaggctgaggcagaaggatcacttgaacctgggaggtggaggttgcaatgagccgagattgcgccactgcactccagcctggggaacaagagcaaaaactctgtctaaaaaaaaaaaaaaaaaaaaagggccaggcatggtggctcatgcctgtaatctcagcacttcgagaggctgaggtgggcgggcggatcatgaggtcaagcgattgagatcatcctggccaacatgatgaaacccagtctctactaaaaatacaaaaattagctgggtgtggtggcgggcgcctgtagtcccagctacttgggaggctgaggcaggagaatcgcttgaatctggggggtagaggttgcagtgagccaagatcatgccactgcactccagcctggcgacagagcgagactccatctcaaaaaaaaatatatatatgtgtgtgtgtgtgtgtgtgtgtgtgtgtgtgtgtgtgtgtgtgtaaacaataaatacataaattgaggagaaggcaggggaaccaggatttgacagtgacaagaaagaaaagcccaggaggacctggtggctgagccagatgctggggctggactaagggtgatgggagcagagctgggacctttgggtggcagagaagttctaatcagtgaaactgggcaaagctatttggatggagcagtagagttggggttaagagacagagacaggccgggcctggtggctcacacctgtaatcccaacagtttgggaggccaatgtgggaggatcattgagaccaggagtttgagaccagcctgggtaacatactgaggccttgtctctacaaaaaatttaaaaaattagccaggtgtggtggtgcgtgcctgtggtcctagctactcaggaggctgaggtgggaggatcgctcgagctcagtagactgaggctgcagtgagactagatcgtgccactgtactccagcctgggccacagagtgagaccctgtctcaaaacaaaacaaaacaaacaaacaaacaacaaaaaaaagaggcagagagacaaaggcggcgaagaagatggaatgatgatgcctttcgggtaggtttggtgttttgggttgtaaaagggaggataaagaagtaggagaaagtagaaagaacactaattgggactcaggtaatggcttcaggtagattgtacaggtttgaatgcggggagacaaagcccacgaggagacaagaggaaacaaacttggaggaaagtttctgtgattctaaacacgttccctctcttatctccatgatttcagctagtggtgggatgctctgtgtatgtttcatgcagtttcacatagttgggggctcagtctctccacataaggcattttatttcttttctcttttttttctttttttgagacggagtttcattcttgttgcccaggctggtgcgcaatggggcaatctcagctcactgcaacctccgcctcccaggttcaagtgattctcctgctcagcctcccaagtagctgggattacaggtgcctgccaccacacccagctaatttttatatttttaatagagacagggtttcgccatgttggccaggctggtctcgaactcctgacctcggtgatccacccgcctcagcctccctaaagtgctgggattacaggtctgcgccactgcgcctggcctctccacgtaaggctttgagtggcgtactgggaacgccccgctggtggtgtccttgggtggactgcagggccctctaagtgccccttgaggctgaccacttcggcttccagcatgtctgagatgagatgtgacactctctcctgggagccacctgcaaggtgattatgtattggaacaagctctcttcttgccttattttacagcccaatggagaggaagtaggggtcagagtagtaggggtgtaaaatttggagtcactcttgttgggcgtgtggtttgtgcaagtgacccgacctctctaagtcttgactccctcatctgtaaaatagggatggttttggcaaatagctacccacttagctactctgaggacggtatgacattgtggaggtggcaatgctttgtaaactgcagaggacttttaggtgccagccatcgccatgttttaaatgcggagaactgcatttctcaccacctcgcaaaataaaacttcacagtttatttgggttgggtataattaccgggcgaaaaatgtaaaaataacaatgttttagaaatttccccaaagaagaaacagtattggctggggctgccttcccaggggccctggaatcctgagggtgcctgacctgcaaatgcccagcgcttagcaggagaacagccagatggccctgctagttccctctctgtgcaaacatctctcacccagccgagtcaacaaccctccctgggtcaagaggctcctccatgctgcttctgtgtggtgtagcctagaaactgggcggctggggcacagggctctggactttggttatgtgtttaatctaggtccctgagctacagggtcatctgttttggctccttctctgcttatgtaaacagggctggtgggcccatcagtacagccaggccccgctctcaccccctcctcctgtaaacacattacaaagaatctttgtaactgcccaggaagagcagctctgctcaggggaagagagcctgcatccggagggggtgagactcggggtggagatggatgggggaagagtaggcaggaggggcaaaggtggggcaggagtggtgcttgccaatacctcctgtactatgtggtacagaaaagccagctttgctcaaagtctggccgtgataggagggggcctgttgtctgcagcagaaaccaaggtggtaggaagggtggtgttagaaaaggggagaactggggtggggcatggtggctcacacctgtaatcccagcaatttgtgaggctgaggcgggaggattgcttgaggccaggagtttgagatcagcctgagcaacatgggaagattctgtgtctacaaaaaatacaaaaattagctgagcgtggtggcatgtgcctatagtcctagctacttgggagaccgaggcaggaggatcgcttgaggccaagagttggaggctataatgaggtacgatcacaccactgcactccatcctgggtgtcagagcgagatcctgtctctaaaaaaagaaagaaagaaaaggggagaatctttatttcctaacatcctgcagccctgacacttttcttaccttagcaattcaaacatggttaaaaaaaaaaaaaaggagggggtgccaagtgcggtacttcacacctgcaatcccagcactttgggatgctgaggcgggtggatcacctgaggtcaggagtttgagacaagcctgacctacatggtgaaaccctgtctctactaaaaaaatacaaaaaattaaccgggcctggtggtgggcacctgtaatcccagctactctggaggctgaggcgggagaatcgcttgagctgggaggcggaggttgcagtgagtcgagatggtgccattgcactccagtctgggcaataagagagaaactctttctcaaaaaaaaaaaaaaaaaaaagaactaggccaggtgtggtggctcacgcctgtaatcccagcactttgggaggctgaggtaggtggatcacccgaggtcaggcgagaccagcctggccaacatggtgagaccttgtctctgctaaaaatacaaaaattagccaggcatgatggtatgcgcctgtaatcccagctacttgggaggctgaggcaggagaattgcttgaaccctggaggtggaggttgcagtgaggtgacagggcgccattgcactctagcctgtgcgacaagagcaaaactccatctcaaaataaataaataaatacatacatacatacatacatacataaataaatacaataaaaagaactaaagcctccttttcaagtagtacaggttagaagcaagaatattagctggagagtcaagaaaacaaattgtattcctgctcctacccctaatgagctgtgtgccctttggatgatgccttaacatcttggagtttccttgtctagataaatcagaatgataatatttgccattttttgaacacccttgatatgacagggatttttacctgctattttattaatctacacaaatacccaatgaggtagggtgggttatccccattttagagataaagacattaagacttagctaggagaactgacttgcttaaaaatatgtatgtgtaagtagcaggaacagctcttttgtattccaaacccccattctgcccctgcaactaagaaaggtgggggcggggtggtggctcaaacctgtaatcccagcattttgggaggccgaggcaggaggatcacttgagccaggagttcaagaccagcctgggcaacgaagcaagaccctggttttttttttttttttttttttgagacaaagttttgcttttgttgctcaggctatagtgcaatcgcataatcttggctcactgcagcctctacctcctgggttcaagtgattctcttgcctcagcctcctaagtagctgggattgcaggcatgtaccaccacgcctggctaatttttgtatttttagtagagatggggtttcaccatgttggtcaggctggtcttgaactcctgacctcaggtgatccacccgcctcagccacccaaagtgctgggattacaggcatgagccactgcgcccagccagcaagatcctgtttctacaaaatataaaaaattagccaggtgtggtggcatgcacctgtagtcccagctacttgggagactgaggcaggaggatcacttgaacccaaaggcaaaaaaaaaaaaaaaaaaaaaaaagaagaaaaagaaaaaaaaaactatttttattgcttagggacaaagtttctgacttccataaactcaagatcagctggcacggtggctcatgcctgtaatcccagcactttggaaggccgaggcgggcggatcacttggggtcaagagtttgataccagcctaaccaacatagtaaaaccctgtctctactaaaaatacaaaaattagccaggggtgatggtggtcgcctgtaatcccagctacttgtgaggctgaggcaggagaatcgcttgaaccggggaggcagaggttgtagtgagccaagattgcaacactgtactccagcctgggcaacagagtgagactctgtctcaaaaaaaaaaaaaaaaaaaaaaaaaagctcaaggtctggagtcaaagcctctacctctcccagatatctcctcccactgtatttatcaccttggttaaaatccagggaagggaacaatcagcaacttgttccactcggggtagaacttggcaggaactctcgaagttgctgttactacctttccattgcaaggcaattcataaatgtctaaatttccatagtacatcttggaggctgcatgagggagaaagagccagcaacccttatgcctacagacaaaaattagttttttttttttttttgctatggggtctcactctgtcacccagggttgagggcagtggcacgatcttggcttactgtaacctctgcttcctgggttcaagcgatcctcccacctcctacaggtgtgagccactgtgccctgcctatctggccctttatagaaaaatgtttgccatctcctgttctagataaaagtagccatctgagcagggatgagggagggtctcaccattcgggaggtaaatatctatttaatcctcttgttttctctgtagcgtccacaccctcaactgtgcccggtattcctcaggccagcggggtctgattgctggcctgaggggtgtgggatctcagacccaccatggatgggcagccctaaacttccttctcccaccttcaatggttaagtctttacttctgttggtatagagtggtggctgggcttggacttttcaggaaggagactggaaggtgttcctctggagaaactgacccagggctaagagctacagatactggccgggcatggtggctcacgcctgacatcccaggactttgggaggccgaggcaggtagatcacctgaggtcaggagttcgaggtcagcctggccatcatggtgaaacgccgtttctaataaaaatagaaaacttagccgagtgtggcggcaggcgcctgtaatcccagctcctcgggaggctgagacaggagaatcgcttgaatctgggaggcaaaggttgcagtgagccgagatcgtgccactgcactccagccgggtaacagagtgagactctgtctcaaaaaaaaaaaaaaaggtcactttataccacactttgctcttgttaatcagactctgcaaatagcaagtgactgaaccctgcgattcagttacaacaaagacatttgaatggacagagaagatgtttgaggaaagctcctaccttttttttttctttttttttgactgagtcttcctccatcacccagactggagtgcagtgatgtgatcacgctcactgcagcctcaaactcctgggctcaggcaatcctcccatctcagcctcctgagtagctgggactacaggcgtgtgccactatacccagggaatttttgtatattttcttggtaaggacgaggttttgccatgttgcccagggtggtctggaactcccgggctcaagccatcctcctgcactggtctaccaaagtgctaagactacaggcgtgagccaccacacctggccagtgctaacctctttaatgaggattgttattgctttttcttgaagttttgattgcaaatatatatagttttcagtagtttgcccaactctattaattttggtcttgttttgcgtgccagacaggggctttcaaacagaacaatacagttcataaggaacacaggtttaataattgctcagaggaaaaaagacctacctggtaccctctccacaaagacaaatccaaagacacaaaagaaagggagggccgggcatggtggctcatacctgtaatcccagcactttgggaggccaaggcttgagcccaggaggtcgaggctgctgtcagccgagaccatcacgccactgcactccattctgggcaaaacagccagaccctgtctcaaaaaaaaaaaaaagtgatttacaaagtatatttattttttaaaagatacattatcatgcttgctttcactcagataaaaatgctacaagatattttatgggtatagtaagagacagtatgatgccctattcaaattttgtgaaaattgaataggttgctatcatttctacatacatctttcttaacactttctggaatttactcctcttcctctttccacattgcttactgtacagagaaggaggctccataatgggaagggatactatcacatttttaatgattattaacagtaaaaacaatgataaacctccgacgtattaatactacctgccacacacactgtggtggatgctttctacaaattaacctaatccattcctccctattacaagatattattgctatgcccctagaaacaagggatttgaaagtcagaaaggttaaataaattggccaataagtggcagtcagttctcctgctatactatttctagaaaacaaacctttattttttaaggggcttggctattttgagcagaagtgatctgtggtcacacagatcttaatcaccactccccgacagagaataaacatttatcaggatggggccggggaaggtggctcacgcctgtaatcccagcaatttgggaggccgaagtgggaggatcactgaggtcaggagttcgagaccagcctggccaacatagcgaaaccctgtctctattaaaaatacaaaaattagctgggcttggtggcaggcgcctgtaattctagctactggggaggctgaggcaggagaatcgcttgaacccgggagacggaggttgcagtgagccgagatcgtgccactgcactccagcctgggcaacagagcaagaccctgtcccccatcccaaaaaaccaaaaacaaccatttatctggatggtgtcgaaatatttaccacttcccctgcacttctgacttttcgaactttgtgcttttgcctgagttccatctggaatgttcttcttggatggtggagcatgtcgtccacctaaccaattcctacctctcctttgaatacacaccacttagtggaagtcttccctgatccctgccgacaagcttttcaactgcatctctctcttaagctaacccaagtcagtaccggcacccttgctggaatgtcccattttgggaaaggcagtatttcttgtatgaatcttcatttgctctctactgggggtaagtgcacgttagagaataatgaaaacttcaagtcaagggatgcagagtgcgtttaccagttcaacaacctggactttctaccaggccattttcaaactgagctgccacggacagcagcatggactttggtgctagcggggtcggcctgaaatctgcagcctgcatgctccaaggatgcctgaaaagaagggtcgaaccatgggccgctcccaggacccacccttttagtcttcccagctggctcaggaaacaaaggggggccggagagaggcggcgcccagggcgcaacagccggagactggcgctgcgtgcctggggacagaggcctcgtgctaggagccccaagcaactacacacctagccgctggcaagaacaaacagcagtgacagcaacaaacagaaccgacagccgcagaccgccgtcgctgcggcccacaaaggccggaagtgtggcgggtgccggcggccgaggcgccctctctaggacttcggagggcccgcatctcggtggttccctatactggaagacccccgattcccagggcgtgtaccctacgacgggggcctcaaaatgagtcaaaagggagaaaagcctgggcgcagtgactcgtacctgtaatcccagtcctttgggaggccgaggtgggaggatcgcttgaggccaggagttcgagactggcctgggcaacagagagagacctggtctctaccaagaattaataaaatgagccgggtgtggtggggcacacctgtagccccagctattcgggaggcttaagtggaaggatcacttgagccctggagtcagaggctgcagtgagctttgcttgcaccattgcactccagcctgggaaacacagtgagaccccatctcaaaaaggaaaaaaaaggaaagaagagagggaaggagagagggaggaaggacagagggagggaggagggagagagggaaggaaggaagagaggaaggaagaaaggaaggaaggaaagaaggaaggaaggaaggaagaaggaatcgaattcagcggctcacctgtggaagaggaaatccatttacaatgcatccaggcctgagtttcagctgaggggttggagcatggctgattatcatcctggcttcccccagagaccaaggaaactgaggcctggagcaagttcttgcttgctcagggtctcacagtgatccgggtcagaagccaggacttgtgggaccacgatttgtgccctttgcactgcctggactgcctctcatcataaatgaatacggataaaattcgttatgctttcaaagtggtaggaaacacatgacagatcaaagcagacaaaatagtgtgcaagacttttgagaagacgcctcacactcgtcgggatggctacagtttaaatatcccttatctgaaatgcttgggaccggaaatgtttcagatttcagaatttttttttgactttggaatatttgctttactggttgagcagccctaatcccaaaatcctaagtctgaaatgctctaatgagcattttctctaagtgccatgatggccctcaagttctggttttgtaacttttggagctcagatatttggattagggatactctccctgtactaaaaacaaacaaacaaacaaacacaaaaaaccaccaccaccaccaacaaaacaaaacaaaatagcaggtgtttggtgaggatgtggacaaattggaatctttgtgcattgctggtgggaacataacatggtgcagcccccgtgagaaatagtacagcgcttcttcaataaaattaaaaatagaattggctggtgtggtggctcccgcctgtaatcccagcactttgggaggtgaaggcaggcggatcatttgagatcaggagttccagaccagcctgaccaacatggcaaaaccctgtctctactaaaaatacaaaaaaaaatcagctgggcgtggtggctcacgcctgtaatcccagctactcgggaggctgaggcaggacagttgcttgaacctgtgagggggaggttgcagtgagcaaagatggtgccactgcactccagcctgggcgacagagctagattctgtcaaaatgaaatgaaatgaaatgaaataaaataaaataaaataatctctgaaggctaaagagagaaattgggtcagctgaagagtttacagatttgcagagaatagaggcaaggaagctttgtgaactacttttaggttgtgaaacttggtcttgattcagcccccacatggtcttcatatacaaagcttctttgcagaggaagctctttggagaaagataactggtgagatagaaagcacagccaagagataacaagggagacttctctggagaattttgtggatgaagaggaaaaacaaatccataaggtcatggggataatgagttatttgaaatcagaaagagtgattaacatggaggcggggcgcagtggctcatgcctgtaatcccagcgctttgggaggctgaggcaggcggattgcctgaggtcagaagttcgagaccagtctggccaacatggtgaaaccccatctctactaaaaatacaaaaaaattagccgggcgtggtggtgtgcacctgtaatctcagctactcgggaggctgagacaggggaattgcttgaaccagggaggtggaggttgcagtgagccgagatttcgccactacactccagcctgggcaacagggcgagactccatctcaaaaaaaaaaaaaaaaaaaaaaaaaaagcaaaccaaaccaaagcacacaaacaaataaacaaacaaaaaacataaggcaattctctacaggtgttttactgctagaagatcatgctcctcatttcctaaagactcacagagaacagaagactggttgcatgagaagtgaataacaagaggttatagtgcttatttgggttgggggcaaacatgacatttcaatattaacttgtttatttatttatttttcggttatacatcattgctggtatatgtactttattttattttttagagatggggggtctcgctatgttgaccaggctggtctcgaactcctggcatcaagccatccacccatcttggcctcccaaagtgttggtattacaggtgtgagccgctgtgcccaggctaactcgttttttttctttggtccagcaaggcttgtgaatgtgtctgggaacgacgtaaaatctggcttgaaaaaaaaactctcaactcaaagctccaagacagagctgagatgcttttgaaggagacagcctcattggtctccttgtcggagaggccccaacttatcagtaaatattggttaacatctatcatctggtgggactaagcatggaaccaattgcccttgcacagaaggccacgtattgtagtattcaacatagatggaatgaccaggaaaggcaaaaccacagatataaaaagtagattaaggccaggcgcggtggctcacccctgtaatcctagcacgttgggaggccaagatgggcggatcacccaccagcctggtctatatggtgaaaccccgtctctactaaaaatacaaaaattagccgggcatgttggtgcgcgcctgtaatcccagctactcggcagactgaggcaggagaatcgcttgaacccaggaggcgggaggcggaggttacagtgagccgagatggcaccactgcactccagcctggcgacggagcaagaaaaaaaaaataaataaaaaattgctaagattgttattaaatccgctgggagagtctttcatcatgttagcaggatcattgtgtcctctggtggcaataacacgcgactgcaactgacttgcctgtgcagaaaaatctttcctgaatcctgaaagctgcattctgttctattagcttaagaaggaaatctgacactgatccgcacggtgtgttttatgatcctgcacataaagattaggtgctcaaggatgcagaggagcccactgctcccagagcaggtgcctgagcctaggaggcatctgaccagagtctctgtcgcccaagctggagtgcagtggtgcgatctcggctcactgcaacctctgcctccagggttcaagcgattctcctgtctcagcctcccaagtagttgggattataggcacgcaccaccatgcatgcctgtaattttttgtatttttagtagagacggggtttcaccatgttggccagactggtctcagacacttgacctcaggtgatctgcccgcctcgacccccagagggctgatattacagcgtgagccaccgtgcctggccgaacgacaggatttcaagcctgaactcgagaggtagcccagactggggatctgcactgggaagtcatccgcaaggacgtggtggctggagctatagacaaagggaaagttatccagggagagtgagggtgtggaatggggagagagagggcccgcaacacagtcctaaggaacaccagcactttttttttttttttttttttttgagacggagtcacccaggctggagtgcagtggcatgatctcggctctttgcaacctccacctcccaggttcaagcaattctcctgcctcagcctctcaagtagctgggattacagacgcccaccaccatgcccagaatttttgtagttttagtagacacgggtttcaccatgttggcctggctggtcttgaactcctgacctcaagtgatccacctgcctaggcctcccaaaatgctgggattacaggcatgagccaccgtgtctggcccagttatcgctttctgagagaggagtttctccaaagttttcagtttgacataatcaatataaccatcctgcgtattaggggatggctggttcttcactccttcagcatctttggttaaccggtacctcgacttggccatatccacaggtgggggaggtcaggagatgtcacccctagtcactggggctgtggggaacatggtctctgaaatggaacaaggctgaccaggccgatggatggctcacagtgtctgctggaggttccttttgctgctcagggccagggcgtggctggaggaagaggccccacccaggaagttccgcaggggcttacacagtcttcccagacccagaagcacaatctccaaaagagtgaacaagagacggaacccactgaccccaaacatggcttttagaaagatgatcttctccgaggggtgggaaaaggtgcaagttaatctatacgggcaaggctcttggccacatgcaaaggagctgggcatctggaacccatacaggtggtactgcaaccccggcgctgtcccctccaggaccagctgagctcccagctgagccacataagctcagagcagcctgaggcttccagcccctggggtatctctgctgctctcccctccctggatcagggtgtcctcttcctccgtcccctttcatgattcttcccagtgccagatcacgtgatacagagtgaaacccatgtagaggacgctaggtacagccaccaagatgacctggaagacccagaaacgcagcggggagagcgggtggaaggcatcgaagcaggcagccttgcagcccggctgctgggtgtgacacacgaattcactctgctcatcgccatagactccaggcccactggcagccagcagcacaaggcggaatcccaggagcacgggaaacaggaggcgccccacgggggtggagtgccagctctcctccgccagcagccaccacctcaggaacctgccacacatcctgttagggagttttaaaaaaagattattacacgttattgattttttgtttttaaagacctctgttgcccaggctggagtacaatggtgtgatcatagctcactgcagcttccaactgttgggctcaagcaatcgtcctgcctcggcttcctgagtagctgggactacaggtgcatgacaccacgcccagctaagttttaatgtttttatagatatggggtcttgctatgtttcccagtctggtctcaaactcctgacttcaagcaatcctcctgcctcggcctcccaaagtgctgggattacaggtgtgaaccattgcaccaggttatgagtgatttattttttattttttgagacagagtcttgctctgtcgcctagggtgtagtgtagtgtcgcgatctctgctcactgcaacctctgcctcccggcttcaagagattttcctgcctcagccttctgagtagctgggattataggcgtgcaccaccacagctggctaattttgtgtatttttagtagagatggggtttcaccatgttggccaggctggtcttgaactcctgacctcaggtgatccacctgccttggcctcccaaagtgttggaattacaggcgtgagccactgtgccgggccatgtattgatttatgactttgcctgtaacttctgcttctctgcctctaaaaacccttacctacaagccattggggaatttaggtcttacacttgagctggctgattctccttgcttggcaccctgcaataaatgcctcagtttctctcactggaatccacatgtcagtgtttgcagcacccggtggttggacccaagttcgatgaggtaacagacgtccactgggtgtgctgtaatcccgcggaggttttcctccataataaaaggcaggaattggctgggcgccgtggttcatgcctgtaatcccagcactttgggaggtcgaggcgagtggatcatctgaggtcaggagttggagaccagcctggccaacatgatgaaaccccgtctctactaaaaatacaaaaaattagctgggtgtggtggcgggcgcctgtaatctcagctacatgggaggctgaagcaggagaatcgcttgaacccaggagttggaagttgcagtgagccgagatcgcgccactgcactccagcctgggcaacaagagtgaaattccctcttaaaaaaaaaaaagacggcgagaattgtgtgagttgtgcgaggaagaccggatgaccgttatctcatggcctttgcatccaggctttgagccaaattctcaaggactggatcctaacacttggctgcaactatttccttgaccactagggggcaggcaaaagccatagcgaatccggcctagcgctgattggaacctgcttgagaaaaagacctctttgtttaagccggcggtccccaatctctttggcactagggaccggctccgtagaagacagtttttccacggactggggaggggaatggttttgggatgattccagtgcatcccgtttattgtgcactttatttctattattattacatcgtaatatataatgaaataattctacaactcgccacggtgtagaatcagtgggagccctgagcttgttttcttgcaactagatggtcccatctggggttgatgggagacagtgacagatcatcaggcgttagatctcataaggagcgggcagcctacatacctttcttgcacagttcacaatagggttcgtgcttctgtgagagtctaatgctgctgccgatctgacaggaggtgagctcaggcggtaattggagcaatggtcggggggtgggggagcagctgtaaatacagatgaagcttcgaccctgcagctcaccttctgctgcgtggttcggctcctaactggctatgaacgggtaccgggagttggggacccctgccttagactatcttgtctctctctggtggactctcctggggatagttcccaggtaggctggaggaatgatgcacactgaatcaggcaaaagacatcaatcagatatagcaaggtatacatatgttaaggtcctcttcaatttctctgagctttgctttttcaaacttctttcccagtagaattcactgtcccagccaaaaggttcttcgtggtcgtcagaaatatttagtgctttctattgcctttgcttacgtatttattgattcatccagaaattatgtattaattacctattgtattaatatgtgtatttatttatttatttttgagacacggtcttgctctgttgctcaggctggagtgcaatagtacaatcatagctcacagcagccttgacctcccatgctcaagtgatcttcctgcctcagcctcccaagtagctgggactacaagtgtgtgccaccatgcccagataattttttatttttttaaatgtagagacagggtcttgctatgttgcccagactgatctggaactcctggctcaagcaatcctcccactttggcatcccaaagagctgagattacaggcatgagccactgtgcccggacctattgtatatttgattctctggtaggcactggagactcaaaagaacagggaatgtaaaatcccattctgcatggaaatcttttgacctcgacttggcaagctgtcttaggcctccacatctctctgaaatccgaattgctccaggaagttttccctgagtatctcagtagccctgtgtccctctcctcctgccccacacctgcccaggacttgaatcctgtggcttctctctcctcctttatcatcatccatgtctcctgttatagatgaggtcacatctcctattccaattttccttagccctggtctgatcatgtggattttggtttcttcgttgatcttaaatgtttaactttcaccttttatttgctccaagtgtcctcatattcacatttcacatgctatattttttcctcttgattatttgcattttctttttttgagacagagtcttgcactgtcgcccaggctggagtgcagtggcgagatctcagctcactgcaacccctgcctcctgggttcacgtgatcctcctgcctcagcctcccccgtagctgggattacaggcacacatcaccaaacccagctattctcctgcctcagcctcccaagtagctgaaattataggcacacaccaccacacccggctaattttttgtgttttcagtgaagacggggtttcactatgttggccaggctggtcttgatccttgacctcgtgatccgcccgcctgggcctcccaaagtgctgagattataggcgtgagccaccgcgcctggcgactatttgcattttctttcctgaacttggctactgttcatataggatgtttttgccctggaagggagaaaggtggatttcatgtagactttaaaaaaaaaagtaatttctcagctttgattttcaaattggagtcgaagagttaaaacaaaaaattgtagccttcaaatttaggctttcatgaaagataagatgattaactcagaattccaaagactgggaatgattcttctatggaacccagcttggaggatggattttggaataatccagagtgggaggctgagtataggatgtaaagaaagttcttgtcgctagacacagtggctcacgcctgtaatgccagcattttgggaggccgaggcaggcagatcacctgaggtcaggagttcgagacgagccttgccaacatggtgaaaccctgtctctactaaaaatagaaaaattagccgggcgtagtggctgatgcctgtaatcccagctacttgggaggctgaggcaggagaatcgttggaacccgggaggcggagtttgcagtaagccaagattgcaacactgcaatccaggctgggcaacagagcaagactccatctcaaaaaaaaaaaaaaaaaaaaaaaaaagaaaaaggaagaaaaaaaggaaagttcttttcccacaggaaggaaaagcacagacacaggcaggtgaggcttcatgagaaggtcaaggtgagagctctgctgtgtgtttggggttgatacctgtgcatggcagttggcgactcatttgaggaaactcactctcagggactcagagggagtctgagaacctcagggccaattcccgcttcattgagctgtaccctggagagctgagagctctcaaataagctttggctggtgggccaaggcgaacatggtgtggagatgtggagcagctggagtggagggctgggtctcccaggaagccaagaagtgtggggaaactgaggcacagaagaggcttggctgtgtgaaagagcttgcagggttctagcacctcacagccagagtggccatggccacgcctgtggatgtcagcaggggacacctgaacaatccctaagggacagcgggtccgggccatgcttgggattgcccaagtcagggtgcccaggaaccatggcctccaagggaaaccaagagtttcagatgaattcagtgcttgggagcaggaccaatgagaaaatcacatcacatttctatagcattttacagttaatactgttctctgtcgtgcttgacaaagagagatgattatttattagtttccacagattagacaatggcggggggtggttcaaggtgagatggtttttgggtccgagtcagctcaggacaggcatcccagtcttcggtctccaaatccacctcctgtctgtccccccacactgctccttgggccttgaggatccattgaccgtgatttcggtggttcagctcccacatcaggcaggaagggcagctactggggctgagatcccacattgcctccagcccttgcttcctacctggcctccccgggcaccacgaggggctgggccaggctgctgtgctgcacgtggcaggagtagggggctgtgtcctgcgggggcacatgcaccaacaaccaggtcaggtaagtgccgtttccaccgtgaagaacatctccccgtaactcaggctcctgcacctcgccggcccgagtccagtgcacatcaattttccctgggtagaagtcgtaggccaggcacttcagtttcttcttttctcctggggcctggtggctggtgaccaccacagagggaggatctgtggagggatagagtgtgacactgcaggtttgaggtcgacttctcccggcccaggtctcttctcacccctacccctggatgtcagcaatcagcagagctctaagctctgtatctgcccgccccactgccccctgccctgggacactttccagaagatcagggaaggctgaggctttccctgatccttctctgttggatcatggaatgtcctggctcccctctcgcccattctccaccccacccatgtattgactctgataagttgtgaatgctctgtgcactttcccatgttttcccacatctgagtgggctttggagttctgtcccccaatctcagtccagctgcttggttcagcccatgcctctatccagcaaccgcttccctgcagcactgcacaatcctgagtctcactatgtctgcaatccaagtctcagcttgcagccatcgattccattcacactggctcgctgttgtctttctggggctgacattttacacacctcccttctctccaccacccagatgggaggcatcattgtagagagaaacaacgatggcatttggaatctgaaatctggaattcaagtcctagctcttcctttttttttttcttttttttttttttgagactgagtctcacactattgcccaggctaaagtgcagtggcgcgatcttggctcattgcaatctagtcctcctgggttcaagcaattttcatgcctcagcctcccgagtagctgggattacaggcgcctgccaccacgccaggctaatttctgtatttttggtagagacgaggtttcatcatgttggccaggctggtctcgaactcctaacctcaagtgatccacccaccttggactcactcccaaagtgttgggattacaggcgtgagccagcatgcctggctgcagctctgcctcttacacacagtgttaccctcacctctgtcacctccagctcctcatctctcaatgggtgatatttagggaagcctaccagtgaatcagtggctttcctggcccattctgcctgaaattttgatgtcctcctaggaaaggaatgaatcctggaagttgaaaactggggttctacgtgacttacatggatagaggagattggcctaagatgctctctgagctcccagcctgagatcaccttggtttttcccagcttagcactggatagcaggaagcagtgagtaccttgccggtccaggatattttcgctgtatttcaggtatttccgcagagttgcagggcactcctcctccaggtaagccttggcccgctgcacgtagactggttctgcctcctacttctgcttggtgttctgggcttccgggaccaaggggactcaggctgggatttctttgttgaattcaatgtagtcctttccatcataggcattcttccagaatgctccagtgcttctgttattctggatctcacaaccaaacctttcctgcaaggcatgagaccctgaaacctcccctgaccccacaggaagccagtcagcctagtgccaactgaataactcttagtcctgcactcttcacaactcaataggaggaaaggcttttgcaatctaagcatgcagttccgtaatcatggcatatgattttatctggacgtacagttgacacagagtggcaaaggctatatggattggcatttcgggccaatttgagatgaaatatgcattcctcccagccagggaagttaagagagctacaggccgtgggcagatttctgtctcttctgtagcatctctttttatttgtttgaacttacggggagtatttaggaacctgtcacaaccacaccaaagtacatttccgaatttgatagaaattatttgtgattccatatgaggaaaggaaggctctccttttctctcagttctaggtggagttcatatcatcacctaaatcaacctaatctgtctgactatttctttgtttcttttttttgagacagagtcttactctgctgcccaggctggagtgcagtgtcatgatcttggctcactgcaacctccatctcccgggttcaagcaattctcctgcctcagtctgctgagtagctggaattccaggtgcgcaacaccacacgaggctaatttttgtatatttagtatagatggggtttcgccatgttggccaggctggtcttgaactcctgacctcaggtgatctgactgccttggtgtcccaaagtgctgggattacagatgcgagccactgcgcctggcctgatcacttctttcttcctttctggtgtttgatatctttatcccaaatctctaaagtcccaaccttcttgcccattagcaacaactctcagaaatggacctcatagggcagaggacacagcctcttcattctgattataaaaacaggtgtttacctagcacaggttggtgctgttggcatagactctcacagctctcaagctgtctgggctcaagtcccaggtctcttcccgccccaacctggtgtgttgtgtgaactggagccagtcacctccttgtgcctttatttcctcacccctgaaacagcagtgccaaaagcacggtttcagggggttattctgagcattatatatgctcataaatgggcctggcacaaagtaagtgctcagtaaatgtcagctactcttattttctaataccctgtgttcatctcttcatcctccttcctcgtaattatccactttgccatttctattcctgtccatcaatgcttcccccagtgtcttttctgatcacctgtgccccctcctctcctatggctaacacacagcctgggtcattttccttaccaagacctcccatccctcatccttcaaacgtctgcttatctcttgcctcctttgggaaaccttcagatcccatgtagcaccttgggcatttttgtacttagaagcccatcttttgatacccactccatgataatttaacaccagcagttcaccaggcctggggttggctgccttggggctggcagtgtggtttgggagaaagaacgctgggccgggggcagggggaccgtctctgcacgggctctgccaccagctcctccgaccacagtgcaggtggcccttcctgggtctgcatcttatggtgaggaggaactttagggctgcagggatctctaacagcctgtggttttgaatgcagcacttcctgagcccccagcatgggctacggtgtgtgctgggtgcttttctctgttgattccacaaatttcaattgagccaatattggctgtaccctgtgctaggtgatggagctgcaagggagatcaggacagactgtgacatccttcatagaacagacatagttaaatattacagacttgtttggagataggtctcagtgctccaatgtttgcagatttcgaccagatattttgggaacatttcactgtcaacaggtaggactggcagagccaccaggtgagcccaggtctgagtgactttgagagtggctcattctccaggcaacctccctggacaggggtgagtctgatgccttctcatggggagatcagcctctgatgggtggggagtggaggtgagaggtcagaggtgcctagataggaagtgactctgccatcacttcctgtgtgacctgagacctgggatgaggatggggcaatcgatggggaaggggacaacactgtgctgtggggggggtgggatgcggacatgtctgtgtttctgctgtgtctcctgttcctcccctgggattgggactatttccatcctgctgaccccttgccactcacacctggggggctgcctcttgggttagaccttccacccccgcggtctgttgttcactgaccgttaccgtcgttgtaatactccatgatgttgttcagggtctccataaagatgtcctccctggccttctgaacttggctctgcttctcccagtcctctactccttccgcatgtctccatggtcccaggggctcagccttcctgtcttcactgttgtagtggaagaaggcatggccattgaggaagacagtgccctgcagcctgtgggtgcctttgccagacctggacagcccagtgtagagataggtcagagagtaatgacctgcaaaagaaaagactctgagggctggggtccatgcaagggtgtcccattgtggggctgcagagggccaggaggggaggcctggccactggcctcttcctccccagctctctcctctgccatcagcttcacaccattggagcctcactcaaggaaacaggctctactttcatgctggggatgatatttcagagaccattctgtttcttcactacagagtttaatctgcttggcacagaagaagttaacatttctcagcctccttatagatagattggaaccatgtgactgagttttgtcaaacaagaatgtgagtggaagtgactgatgtctttcttctggtccaaggctctaccatctggcttgcccctacggtctcttatccctttcgttgactgtggaggccacaggatgaaacagaagagtcccaagatgcaaacagcctggatccctgagtcaccctgtggaggagaggaaccttgcccaatctgcattgaacttgacatgagaaataaacatttctagtctaaccggacaaatacatatagttagaaagtgtaggaaggtgaatttactagaaaactcaagaagtgacccagaatggatcagcatagggtaaggctaggatacctctcagaattcctggcattgtatcttgcagtttggtacaagatggaagctgagagagtgggacatttccacaattagttccatagttaatttagaatataatttacatgagtgttagtaatgttggaagtcatatggcagatttctaatttaagtactgaagtcattcttgctcatgagtttctgaatgtgattagcctttaaatcagaccttgagtaaaacagattaccctctacagtgtggatgggcctcatccaatcagtggaaggcatcaagagaaaaggctgaggtcccccagagaagaaagaattctgcctctagactacccttggactcaggaccgcaacaccaactctttgcttggtctctagcctgctggcttgctttgctggtttaggacttttagccctcagaattgtgtgagccacaagaaatattaaataaaactcctccctttctctgttttgtatatacatacacgtatatatgtatattatacatatacacatatatttagtgtacatatgaatatacaatgtatattcatatatacatacgtgagtgtttatacaatgtatattagttttgtttctctggagaaccccgaataattcatatttgggtgcagaatgggattaatattataaatgtgattattataaaactaacgtgaaacacctattttgacaatttgtaaatgtcatgaattttattttattttatttatttatttatttttttgagacagagtctcgctctgttgcccaggctggagtgcagtggcgcgatctctgctcactgcaagctccatctctcgggttcacaccattctcctgcctcagcatcccgagtagctgagactacaggcccccgccattacgcccggctaattttttgtatatttagtagagacggggtttcaccgtgttagccaggatggtctcgatctcctgacctcgtgatccacccacctcggcctcccaaagtgctgggattacaggcgtgagccaccgcgcccggcatgaattttaaactcacacaactgagaagccattcacttccatgtctttatcctgcacattctcatgccacaaacagcctccttcccctctcctataaatgaatcttgatctccccaagctcccactgtcttctcttccggccactcgctttccagacccactgcagtggtgtctgagtgtggggtgagggcacgggtttccttctagcaccatccctccagccaacctgccttcccactttccccttgggggctgttctctcttttcctcagcgtcaggcaggtgtacccagccatcggaaggagggaaggaacaggagcagaagcagctccaggcctgtggttcctgctccgtcctggctctccaccccaagcaggtcgcttggtctttggagtctttgttttcactgtaaactaaggggttttagattcagattcctgaaggtcttattttgggtgagggcagaggctccctgaatgctcctggaagtgtgtgagctgagggagttgacagccttggacacctgttcctgccatatgccagggaatcccagctgcatccagcccttctcccagccacatgtcctgttcctcacctccttccagtcctctccagcacccatcccttgctttccccactcaccatctcgggtctcctggaggacagcaggacccagaagcagcagcagagacagcaggacagacaccattcttaccattgtgtctgcttggaaggttctgggcaggaggcacaggtattatcctgggtcctggggccatgcccaggggaggtgaatctacaggccaatgggagtaccaggccgggctcctcccctgacagtaagaaagaagtatgcacaagccaggctgggcagaggttgtgatcagtgagtctacacacaggatatgcaaatttagagctgagacagttgatctctggactgaggatttgtgtgtgcctggggcggaaggatgccagtgtgtgggaggtgtgtgtgatgggtggcaggtgcctgggatgtgtcgcccttccagtctattatgacaccctctggggtcacttgggtgttgtcagaccacacttcatctctgccttctggaaaaactctcaacatgtccaagacacggacatgggtagacccccgctggggtgggaccctcactctcccacatccgatcctgccagagctgtctggaggacattcccattcccatctctccctctttcctttaggtgcctgtggaatcccagccttccatgatggaagcagaaatagccgcatcctccttttgcagcctccctggcaatagaacgagcaggtgtgcacagggtttatgctcagcaagtcgaagctactgccttggatatcaggtcaagtgttagggaaacaaagaggagggcacagtggacaatgttttctggtggtcttggcaggggttgcaactgccagctcccggggcagtggggctgcagtagctgcggggggcgtcttgagcttcagtcccccgggatgttgtagatcccgtgctgtggcctctgctgccccctgctggcagcttctgtatatttactgggccggttgcaggtgtgattttgactgttgggctcctctggaattctgagcctgggttctccatcctttctgtggattctgagagctaaccaataaatacgtttattttctgcttaaggtcagaactgcattacgtttccaataacaaatactcctggcggatacagagattggtacaaggattgtttccaggcagtatttactcagggaaatggagggctgggaagctgaggttggttactgggccagattggggctgcgcagtgaaaacacaagagtcttgggggattctggcaggcctggtgtgcagtgataacttcaacagttggctgaggtatctgttatggtagattggtgtagggaccagccccacagggtcggagggtttttctccccgtgtgcagagacgagagagtgtagaaataaagacacaagacaaagagataaaagaaaagacagctgggccccggggaccactaccaccaagacgtggagaccggtagtggccccgaatgtctggctgcgctgttatttattggatacaaagcaaaaggggcagggtaaagagtgtgagtcatctccaatgataggtaaggtcacgtgggtcatgtgtccactggacagggggcccttccctgcctggcagccaaggcagagagaaagaggaagagagagagacagcttatgccattatttctgcttatcagagacttagtactttcactaatttgctattgttatctaaaaggcagagccaggtgtacaggatggaacatgaaggcggactaggagcgtgaccactgaagcacagcatcacagggagacggttaggcctctggataactgcgggcgggcctgactgatgtcaggccctccacaagaggtggaggagtagagtcttctctaaactcccccaaggaaagggagactccctttcccggtcagctaagtagcgggtgttttccttgacactgaggctaccgctagaccaccgtccgctcggcaaggggcgtcttcccagacactggcgttactgctagaccaaggagcccttctggtggccctgtctgggcataacagaaggctcgcactcttgtcttctggtcacttctcactatgtcccctcagctcctatctctgtatggcctggtttttcttaggttatgattatgcagcgaagattattataatattggaataaattataatattggaggattattataatattataatattggaataataaatttggaaaaaactaatgattaatgatattgatatataatcatatctatgatctagatctagtataactcttgttgttttatatattttattatactggaacaactcatgccctcggtctcttggcttggcacctggatggcttgccgcccacatctcccccctttttattaactaggatcgccatcgccatcattgcttgtcgttgacttcggatttgttttcggactccttggaggcatctgcaggctaaaaggagacaacgtaagcataccaatattaataatgccagtgacaacaatgatcctccaaggggtttgatctatttaaagggattaagatcagataattgtttagttatgccttcaaaaatgtctgagccaggaacagtggataaatgagcttgtgaatcctcgaaaatttgctctttaagttttgaaatatccaaggttaagttatcatcccaggcttttaaatgtcttgagacattttcccagctatgttgatatttattataagcataaggcattatgcaataatcagaagtattccaatcactctgtaattgcatacggtgttccaaattcatatctcccagccagattacactttggcggagatcattaatttgattagctaatttttgatcaatttgagcctgagaattccaaagtctggaggagtttttctgccatgcttcaattcaacatattgaacggtttgaacagaattgtggatggcaactccagcagttgctgctgttgcagtaaccgcaattagtcctgcaatgatggcaataagagtaaaaataaatctctttgttcttttgcggatacctttaagaacttcattgactatgtgaatagagggggaagactcccatggacgatgtaaagaaactggtatccataccccctccctagcccttaccaagagagtacttgtagtgggattaaaagtagcatcaatgcacgtgaacagcttacagttatcacattctatagtttgtgtattgggaatgataattatatttccaaccaacagcatgtaagggggtttgacatagctcctgatgggtatcacccgttcagatatgagggtgatgttgaatgtgggtgttttggtattagtgtgaaggagttgataggtagtgttccatatccttattcctgtcatagctgcagctaattttcatagttgaggatgttctggggtaacaaagggatgaatcatttttggtctaggaggagtaatgcctgcatccatccatttaaataggtaaggggacacccattgtctcagcctgtatgactgccatccatcctctacataatctaacaaataattaaactctgagcatgaggtatttttgctggagcaatcttgccaataatgcccttttggagcccaatcaataacaatacctgcggctagactttggagcacaacggccttaggagcattacaattattccataaaattgaagtcactataaaaggtccctttgtaggtttctttaaccaaaagagaggctgggcacagttgctcacactagtaaacccagcactttgggagaccgaggcgggcagatcacgaggtcaggagttcaaaaccagcttggccaacatggtgaaacccctgcctcagcttcctgagtgctgggattataggcatgtgccaccacgcgcagctaattcttgtattttttcagtagagacgaggtttcatcatgttgcccaggctggtctcgagtacctgacctcaacctgaggtgatccaaccacctcagcctcccaaagtgctgggattacaagcatgagtcaccgcacccgggccccagtcactttagaatagcatgttgctttgtattcggagggtctctctgcaaatagcccatcaacactgagcgtgcctggaaagacctggttttcaaataactggcttcgtctgtgtaaaacgagtcttgttgtatgcattaaaaattatcttggctgggcgtggtggctcacgcctttaatcccagcattttgggaggctcgttctgttgccagggaggctgcaaaaggaggatgcggctatttctgcttccatcatggaaggctgggattccacaggcacagaaaggaaggagggagagatgggaatgtgactgtcctccagacacagcctctggcaggatcggatgtgggagagtgagggtcccaccccagctggggtctacccaggtccatgtcttggacatgttgagagtttttctggaaggcagggatacagtgtggtccaaaaacacacaaatgcccctactggcccaggggttgtcacaatagactggaagggtgacacatcccaggcgcttgccacccatcacacgcacctcctacccactggcatccttccaccccaggcacacacaaagcctcagtccagagatcaactctggactcagctctgaatttgcatatcctgtgtgtagattcattcttcataacctctgcccagcctagcttgtgtatcatttttttttctctattaggggaggagcccgtcctggcactcccattggcctgtagattcacctcccctgggcagggccccaggacccaggataatatctgtgcctcctgcccagaaccctccaagcagacacaatggtaagaatggtgcctgtcctgctgtctctgctgctgcttctgggtcctgctgtcccccaggagaaccaagatggtgagtggggaaagcaagggatgggtgctggagaggactggaaggaggtgaggaacaggacatgtggctgggagacaggctggatgcagctgggataccctggcatacggcaggaatgggtgcccaaggctgtcaactccctcagctcacacacttccaggagcattcagggagcctctgcgctggcccgaaataagaccttcaggaatctgaatctaaaacccctagtttacagtgaaaacaaagactccaaagaccaagcgacctgcttggggtagacagtcaggacggagtaggaaccatatgcctggagctgcttctgctcctgttccttccctccttccgatggctgggtacacctgcctgacgctgagggaaagagagagcagccccaaggggaaagtgggaaggcaggttggctggagggatggtgctagaaggaaacccgtgcccaaatcccacactcagacaccactgcagtgggtctggaaggcgagtggctggaagagaagagagtgggagctccgggagatcaagagtcactcctaggataagggaaggaggctgtttgtggcatgagaatgtgcaggataaagacatggaagcgaatggcttctcagttgtgtgagtttaaaattcatgacatttacaaattgtcagaaaaggtgttatatgtttgttatataacaatcactttggaatgttaatctgattctgtgccaaaatctgaattactcagggttctccagagaaacagaactaataggtggtacacatatacatatatatgtacgtacacatacatacatacactgtatacacatggatacacacacacataggaagagatttacatatatgtatacaaaagagagagagagtagagatttattttaagaaattgactcacactattgggaggagtaacaagtcctaaatcttcagagccggccagcaggctggagacccagggaagagttgatgtcttagtcttgattccaagggcagactgtaggcagaattctttcctctttaggggacatctgaggctttttctcttaaggccttcaactgattggatgaagcccaccactatggagagtaatccactttactcaaggtctactgatttttttgtaaattaaaaaaaaaactgtgggtgcatagtatgtgtatatatttatggggtacatgagaggttttgattcaggcatgcaatgtgaaataatcacatcatcaaaaatgaggtatccatcccttcaagcttttatcgtttgtgttacagacaatccaattatacttttttggttattttagtttttaaaagtatttgattatttatttatttatttatttttgagacagagtctcactctgtcacccaggcaggagtgcagtggcatgatctcggctcactgcaacctccgcctcccaggttcaagcaattttcctgcctcagtctcctgagtagctaggactacaggcacctgccaccacacctggctaatttttttgtatttttagtagagacgggtttcatcatgttggccaggctagtcttgatatcctgacctcgtgatctgcccgccttggtctcccaaagtgccgggattacaggtgtcagcaactgcgcctggcctctcttttggttatttaaaagtgtacaattaaattatgattattattattatttttgagatggattcttgttctgtcacccaggctggagtgcagtggcgtgatcttggcttactgcaaacctccgcctgttgggttcaagcaattatcttgcctcgggtgtacactgccacacacggctaacttatgtatttttaatagagatagggtttcaccatgttggctagactggtcttgacctcttgacctcaagtgatccactcacttcagcctcccagagtgctggaattacaggcacgagccaccacacctggccccagttaaattattattgactatagtcaccctgttgtgctatcaaatagtaggtcttattcattcttctttttttttttttttttgtgacagagttgcccaggctggaatgcagtggtgcaatcttggctcactgcaacctctgcctcccgggcttaagcgattctcctgcctcagccttctgagtcgctgggactacaggtgtgtgccaccacgcccggctaatttatgtatttttagtagagatggggtttcaccatgttggccaggctggtttcgaactcctgacctcaagtgacccacctgcctcagcttcccaaagtgttggaattacaggcatgagccaccacacctggccccagttaaattattattcactggagtcactttgttgtgctatcaaatagttttctaactattttttttgtacccattaaccaccctcccaatttccccccaaccctgccactacccttcccagcctttggtaaccatccttctactctctatgtccatgaattcaattgtagggtctactgatttaaaggctaatcacatttagacactcaggagcaagaataattttagtaattgaactaggattctgccatatgacctccaacatcattagcacctgtgtaaattgtatcataaaataattatggaactattatggaaatgtccctctctcccagatcccaccttgtaccaaaatgcaaggtacaaccccgggaattctgagctccatcctagtcttaccctgtgctaattcagtctgggtcatttcttgaattttctggtaaattctcctttctaccctttctaactatatgtatttgtcaggttaagctagaagtgttaatttttttttttttgagatggagccttgctttgtcacctaggctgaagtgcagtggcatgatctcagctcactgcaagctccgcctcccgggttcatgccattctcctgcctcagcctcctgagtagctgggactacaggcacccgccaccatgcttggctaattttttgaattcttagtagagacggggtttcaccatgttagccaggatggtctcgatctcctgacctcgtgatccacccgcctcggccccctaaagtgctgggattacaggcgtgagccactgagcccggacgaaatgttaatttgttttttttgagacggagtctcactctgtcatccaagctggagtgcagtggcatgatcttggcttgttgcaacctctgcctctctggttcaagtgattttcctgcctcagcctccagcatgactgggattacaggcccgcaccaccatgcccagctaatttttgtattttttaatagagatggggtttcaccatgttggccaggctggtcttcaactcctgatctcaagtaatctgcctgccttggcctcccaaagtcctgggattacaggcatgagccacggagcccagcctagaaatgttaatttctaacgcatgtcagattccatgcacactgggcaaggttccattcctccatggggtgactcagggatccaggccaattgcatattgagactctttcatattatcctgtggccttcaaagtcgtcacctctagggatgagaaacaaaagggacaagccagctggtagggtcttggacaagaagaaagacatcacttctgctcacattctcttttgacaaaactcagtcacatggtcccaatatatcttcgaggtggctgagtaatgttatcttcctatgtgtcaagcagaggaaataatgtagtgaagacacaggatggtctctgaaatatcatctcaggcatgaaagtagagcatattcacttgagtgagcctccagtggtgtgaagttgatggcaggagaaagagctggggaagaaaaggccagtggcaggtctcccctcctagccctatgcagccccacagtgggacccttgcatggacctcaaccatcagaatcttttcttttgcaggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacatcgtggagtattacaacgacagtaacggtcagtgaataacagaccacaggggtggaaggtctaacccaagaggcagcccccccagtgtgagtggcaagggatcagcaggatggaaatagtcccaatcccaggggaagaacaggagacacagcagaaacacagacatgtccacatcccacccaccccacagcacaggtgctccccgcttccccatcaattgccccatcctcatcccaggcctcaggtcacacaggaagtgatggcagagtcacttcctatccaggcacctatgacctctcacctccacaccccacccatcggaggctgatacccccgtgagaaggcatcagactcacccctgtccagggaggttgcctggagagtgagccactctcaaagtcactcagacctgggctcacctggtggttctgccagtcctagctgttgacagtgaaacgttcccaaaatatctggttgaaatctgcaaacattggagcactgagacctacctccaaacaagtctgtaatatttaactatgtctgttctatgaaggatgtcacagtctgtcctgatctcccttgcagctccatcacctagcacagggtacagccaatattggctcaattgaaatttgtggaatcaacagagaaaagcacccagcacacaccgtagcccatgctgggggctcaggaagtgctggattcaaaactgtgggctgttagagttccttggagccctaaagttcctccttaccatacgatgcagacccaggaagggccacctgcgctatggtcagaggagctggtggcagagcccgtgcagagatggtccctgtgcccccggcccagtgctctttctcctaaaccacactgccagccccaaggcagccaacctcaggtctggtgaactgctggtgttaaattatcatagagtgggtgtcaaaagatgggctactaagtacaaaaatgcccaaggtgctacatgggatctgaagattttcaaaaggaggcaagaaagagataggcagatgtttcaaggatgtggggtgggggaggtcttggtaaggaaaatggcccaggctgtgtgtcagcaataggagaggagggggcacaggtgatcagaaaagacactgggggaagcattgatggacaggaatagaaatggcaaagtggataattaagaggaaggaggatgaggagatgaacacagggtattagaaaataatagaaggcagggcttggtggctcactcttgtaatcccagcactttgggaggctgaggcaggcagatcacctaaggtcaggagttcgagaccagcccggccaacatggtgaaaccctgtctctactaataatacaaaaatagcctggcatggtggcacacgtctgtggtcccagctactcaggaggctgaggcaggagaattgcttgaacccaggaggcagaggttacagtgagccaaaatcctaccattgcactacagcctgggtgacaagagtgaaacgttgtctaaaaacaaaaaacaaaaaacaaaaaaaggaaataatagtagctgacatttactgagcacttactttgtgccaggcccatctatgagcatatataatgctcagaatagccccctaaaacagtgctcttggcattgccatttcagaggtgaggaaatagaggcacagggagttgagtggctccagttcaggcaacacaccaggtgggggtggggggctggggagagacctgggacgtgagcccagacagcttgagagctttcagagtctatgccaacagcaccaaccagtgctgggtaaacacctgcttttatcatcagaacaaagaggctgtgtcccctgccctatgaggtccatttctgagagttgtggctaatgggcaagaaggttggggctttagagatttgggataaagatatcaaacaccagaaaggtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaatctcagctcactgcaaactttgcctcctgggttcaagggattctcctgcctcagcctcccgataactgggactacaggctacaggcatgtgtcactactcctggttaattttttttttttttttaagactgagtcttgctctgtctttcaggctgatgtacaatggctccatctcggctcactacaacttctgtcccccaggttcaagcgattctcctgcctcagcctcatgagtagctgggattacaggcatgtgccagcacacccagcaaatttttgtatttttagtagagatgaggtcttaccatgttggccaggctggtctcaaactcctgacctcaggtgatcctttggcctcagcctccctaactgctgggattacaggcatgagccactgcgtccagcctaattttatatttttggtagagatggggtttcaccatattggccaggctggtctcgaactcatgacctaaggtgatccatcctcctcagcctctcaaagtgctgggattacaagtgtgagccactgggcctggtgcttttttttttttttttttttttttttttgagatagggtctcactctgtcacccaggctgaaatgcagtagtgtgattttggctcattgcagccttgacttcccaggctgaagtgatcctcccacctcagcctcctgagtagctggggctacaggcatgcaccaccatgctgcgctaatttttatattttttgtagtggtgggatttcgccatatcaccctggctggtctggaacccctgggctcaagcgatccactcgcttcagcttctcaaagtgctgggattacaggcatgagccacagcgcccaggctgtagctctcttaaggaggaacatatctcatctgagacaaacctgaaatgccaaaccaaactgagttagcccctctctgtctgttgtatatattggagtaataacctatttgtcttgataaagggattgcatgcttgaattgcaaaaacctttatttcttttgggttgcccaatgtgcaagactaagagttattttgataaatttctcaccaggctgactgtctctctgtggggtcgggggagttttcagggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaaggtactcactgcttcctgctccccagtactgagcccagaataaaagacgatctcaggctaggagctcaggcaacatcttagtccggtctcatctgttcctggatgtccctcagacccccagctttcatcttttaggatttattccttccctgggataatataatttgtggtccaaaaagaacatcatcaaaatttcaggcagaatgggccaggaaggccattctttcttgatgagtgtccccaaatcatctccaattaacagacaaggagcttgaggttagggaggtgagggtaacactgtctgtaagaggcagagctgggactcaaattccagatttcagattccaaatcccatcgttttttatctctacaatgatgcctcccatctgggtggtggagagaagggaggcgtgtaaaatgtcagccccagaaggacaagagcaagccagtgtgagcggaattgatggctgcaagctgagacttggattggagacgtagtgagactcaggattgtgcagtgctgcagggaagtggttgctggatagaggcatgggctgaaccaagcagctggactgagactgggggacagaactccaaagcccactgagatgtgggaaaacatggagaagcacacggagcattcacaacttattgccgtcagagtcaatacatgggtgaggtggggattgggcaagagggaaagcgtcagccttccctgatattctggaaagtctcccggggctgggggtgggcaggtacagagcttcgagctctgctgatcgctgacatccaggggtgggggtaggaagagacctgggccgggagaagtccacctcaagcctgcagtgtcacactctatccctccacagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctaggaagcaagggttggaggcaatgtgggatctcagacccagtagctgcccttcctgcctgatgtgggagctgaaccacagaaatcacagtcaatggatccacaaggcctgaggagcagtgtggggggacagacaggaggtggatttggagaccgaagactgggatgcctgtcttgagtagacttggacccaaaaaatcatctcaccttgagcccacccccaccccattgtctaatctgtagaagctaataaataatcatccctccttgcctagcataacagagaatcctttttttaacggtgatgcgctgtagaaatgtgactagattttctcattggttctgccctcaagcactgaattcatctgaaactcttggtttcccctggaggccatggttcctgggcaccttgacctgggcaatcccaagtgtggcctgaaccccctttcccttggggattgttcaggtgtccctagacgccttgtggtattgtacctaatacccatgaagggagaggatgatattacttgccagtgtacacccccctgtgatattgttcataatgtccagagtgaagaaagatgatattactcccaatatcacagaaggtgtacacccccccttgatattgttcctaatacccagttggggaggggagaatatctctcccaatatacaaggggtgtttaaactctctgtgatattgttcctaatattcaggggggacaaggatgatattacccaaatattgcaggggttgtacaccccccctttgatattgttcctaatatccaggggtggagaggatattactcccaatattgcaggggtctacatcctccccccgtgacattgttcttaataaccaaaaggtgagaagctgacattactcccaataccacagggggtgtacaccccctatgagatattgttcttaatatccaggaggggagaaaatgatattactctcaatagcgcagggaatttacatcccccgtcgtaatcttgttcttaatattcaggaagggagaggatgatacgactcccagtatcgcagggggtgtgcacccccccgtgatttttttgctaatatccagggtgggagtggataatacgcaggaagtgtacaggtctctgtgatatttttcctaatatccaggggggagaggaagatattacttttaatagtgtacggggggtgtacacccctctgtgatagtgttcctaacatcttgggagggagaggatgatattactcccaatatcgcagggggtgaaaacttttttttgatatttttcctaatatccaggggtggagacgatgaaattactcccaatatcacagaaggtgtacactccttttgtcatattgttcctgatatccagggtaggagaggatgatattacttctaatatcgcaggaagtgcatacgcccttgtgatattgttcctaacatccaaaggaagagagaatagtattacttccaatatcgcagggggtgtacagccccccttgtgatattgttcctaatatccaagatggagaaatttctattattctcaatatcacaaaggatgtacaccaccaccgtaatattgtttgtaatttccagggaggggagaggataatattactcccaatatcccaagggttgtacacccctctgtgatatttttcataatatttaggggtgaagaggatgatataaatgcaaatatcacagggggtggtcactgtcttgtgatattgttcgaaatatccaagaggggagaggatgaaattactcccaatatctcagcgggggtacacccctctgtgacattccttgtagtattcaggggaagagaggataatattactcccaatgtcgctttgggtattcattcccctgtgatattgtttgtaatatccaggaaaggagacgatgacattacttttaaaatctaaggggtgtacacacctctgtgatatggttcataatatccaggggaagagaggataatattactcccaatatcacagggggtgtacacccgcctgtaatattgttcgtaatattcagggtggaagaggatgaaattactcccaatatcgcagtgggtgtgtaccccactgtgatattgtttgtagtatccagtcaaggggaggatgatattactcccaataccgcaggagatgtacaccactctgtgatattgttcgcagtatccagagggggagtgggtaatattattcccaatatcgcagtaggtgtacacttccctgtgatattgtctgtaatatccagggaaaaaagaatgatattactcccaaaatttcagggaatgtacaccctcctgtgatattgtgcataatatgcaagggggaagaggatgatattacagcaaatatcacagggggtgtacaagcccctgtgttatagtttgtaatatccagaaggggagaggataatattacttccaaatcacagggggtgtacacccccctgtgatattgtccgtaatatccaggggggagaggatgatattattccgaatatcgcaggggtgtacactctgctgtggtattgttcgcaatatccggggaggaggatgatatcaatcccaagatggtaaacaccctgtgtgtacaccaccctgtgatattgtccataatatccggggaaggggggagaaaataatattactcccagtatcgcagggaatgtacactcccctgtgatattgtttgtaatatgcgggggggaggggagaatatgatactacttccaatatcgcagggggtgtaaacccccctgtaatattgttcgtaatattctgggaggggagaggatgatattactctcaatattgcagggggtatacaccaccctctgtgatattgttcttaatatccagaggaggagaggatgatattattcccaatatcacagggagtgtactctccctttgggatattgttcctaatatccatgggaagagaggataatattactcccaatatcgcagggaatgtatatccccccctttgatatagtttctaatatccaatttgggagaggatattaatcctaatatcgcatggggtgtacacgctccctgtgatattgttcctaatgttcaggttgggagaggatgaggttgtacaccgcctgagatattgggagtagtgtcatcctctcttcccgttgatattaggaagaatttcacaggaggggtgtacatcttctgtgcttttgggagtaatatcatcttctccttccctgggtattaggagcaatatctcgggggggtgtacatactctgcaatattgggagtcatatcgtgttctctcaccctggacagtaggaacaatatcacaggaggggtgtacaccccctgcgatattaagagtagtatcattttcaggccgggtgcggtggctcacgtctgtaatccctgcacttttggaggcagaggcgggaggatcacgaggtcaggagattgagaccattctggtaaacacggtgaaaccccggctctactaaaaatataaaaaattagctgggcgagggggtgggcgcctgtagtcccagctactcgggaggctgaggcaggaaaatggtgtgaaccaggggggcggagcctgcagtgagccgagatcgcaccactgcactccagctggggcgacagcgagactccgtctcaaaaaaaaaaaaaaaagtagtatcattttcccttcctggatattagaaacaatatcacatttggggtgtaaaacccctgctatattggaagtaatatcatcctctcttttcatggttattaggaacaatatcacaggggtgtatacaccttctgcgatattgggagtaatatcatcctttccccacctggatgttaggaagaatattgcaggcggagggtacaccccctgcgatattgccagtaatatcatcttattccttcctgaatattaaaaataatatctctgggggggtgtacacccccttcaatattgggggtaatatcattctctttcccccgggatattggaaagaatatcacggggtggtggtgtacaccccctgcgatattggtagtagtatcaacctctcacccctaaatattaggaacaacatcacaaagggggtgtacaccccctgagttattgggagtaatgtcattgtctatcccctggatattaggaaaattaacacaggaggtgtgtacacctcctgcaatattgggagtaatatcaacctttccccaccaggatattaggaacaatatcatgtgggggtgtacacctctttccatattgaaagtaatatcatcctcttttttcctggatattagaaacaatatcacaggaggttgtacacctcctgcgatattgagagtaatatcatcctctctccttctggatattaaaaacaatatcacaggcagggtgtacaccccctgcaatattgggagtaatatcatcctctctccacttggatattaagaacaatgtcacagggggtatgtaccccccctgcgatattgaaagtaatatcatcttctctttacctaaatattaggaacaatgtcacagggagggtgtataccccctgcgatattgaccataatatcatgctctttcttcttggatattaggaccaatatcacaaggggggtgtacaccctctgcaatattgggagtactattatcctctccccacctggatattaggaacaatatcacagagaaggtgtacaccctcttcgatattgggtgtaatatcatcctctccctacttggaacaatatcacggcattggggggaggctgtacactttctgcggtattgacagtcacatcatcctctcaccccctggatattaggaacaatgtcacagaaggtgtgtacacgccctacgatattggtagtaatatcctctctccacctggatattaaaaacaatgtcacagggggtatgtacaccccctgcgatattgggggtaaagcaacctttccttctttggatattacataaaatatcacagaaagggtgtacacctcccgcgatattgggagtaatatcatcctctccccacttggatattagaaacaacatgatgggggttgtacacttcctccgatattgggaataatataatcctcttttgccctcgatattaggaaaaatattacattaagggtgtacacccccttcgatattgggagtaatattatcctctacccccccgatattaggaacaatattaccagagaagtgtacaccccctgagacattgggataatatcctctccccgcctggattttaggaacaatatcacagtgggggtgtataccccctgcgatattaagagtaatattatcacagggaggtgtacactttttgagatattgggagtaacatcatcctctcgcccccgaatattagaaacaatattacggagtggggatacactccctgcgacattgggagaaatatcatcctcttccctctgaatattaggaacaaaatcacagagggttgtatattccttgcgatattggcagtaatatcctctctgcccctggatattaggaacaatatcacagaaggggtgtatcccccttcgacattgggagtaatatcatcctctctgccgctggatattaaaaacaatattaaaggggggtgtaaaacccctgcgatattaaggtaatatcatcctctccccccccggatattaggaacaatatcacagggggagtgtacaccccctgctatattgagagaaatatcatactctcctcaaatggatattaggagtaatatcacagggatggggtgtacacgttctgctatattgggagtaatatcatcctctccctacctggatattaaatacaatatcacagggggtgttaccccccctgcaatattgggagtaatatcatcctctcccattctgaatattaggaacaatatcacagtgggggttgtacaccccctgtgatattggcagtaatgtcattctctcccgctttgaatattaggaacagcatcacggaggttgcacacaacctgcaatattgggagtaatgtcattttctcttccacctggacataagaacaaatattacagggaggaatacaccttctgcgatattggagcaatatcatcctcatttcccctggatattaggaaagatattacagtggggggtggacacccctgcgacattgggagtaatattatcctctgccccgttggatattagaaaaaacatcacaaaggaagtgtacaccccctgctatattgggagtaatatcatcctctcccccctggatattagaaacaatatcaagggggagagtacaccaccttcgatattgggagtaatatcatcctttgcccttctcgatattaggaacaatatcgcagtgtggtgtacactgcctgcgatattggaagtagtatcatactcttcctccctcgatattatgaacaacatcacagggttgtgtacccccctgcaatattgggtttaatattgtcctctctttccctagatattactaacaatattaccagggagtgtacacacagggtgtttaaaatattaaacttgatgtcatcctctcccccccggatatggcaagcaatatcacatggaggtgtacaccccctgtgatattcgaagtaatataatcctctccctccctggatattacaaaaaatatcacagcggaatgtacaccccctgcgatatggggagtaatatcttccatttcctccataaatattatggacaatatcacaggggcatgtgaaccacccgtgatgtgggaaataatgtcatcctctccccttctgaatattacaaacaatattacaggggggtgtacacaccttgtgatataggaaataatattattttctccccctctggatattacaaacaatatcacggagaggtaatatcatcctctcccccactggatattatgaacaatagcacaaggggatgtacaccccctgtgatatggggagtaatatcatgccttcccccctgcatattaggaacaatataataggggggtgtacatcttctgcgatatggggagtaatatcttcctctccctccctaagtattacaaacaatatcacagggggatgtccactccctgtgatatgggaagtaatgtcatcctctccccttctaaatattacaaacaatattacaggggggtgtacacaccttgcgatatatgaaataatattattttctccccctctggatactatgaacaatatgaaagtgggatgtataccccctgcgatatggggagtaatatcattctctcccctcctggatattacgaacaatattacaatcgggtgtacaccctctacgatatgaagagcagtaatctcctctcccccttggatattaggaacaatattacaggggatgtacaccccctgcgatattgggagtaatatcatcccctcccctcctggatattacgaacaatatcacagacggtgtacacacagggtgtttaccatattgggagtaatatcatctcccttccaggagattacgaacaaaatcacaacggggtgtttaccccctgtgatattgggagtaatattatcctcttccctcctggatattatgaacaatattacagaagggtgtacaccctctgcgatattgggagtaacatcactctctccctttctgaatataatgaacaatatcacagggaagtaacatcatcctcttcccccctggatgttacgaacaatatcacaggaaggtgtacactccttgcaatatggggagtaatatcatcctctttcccctgggtattaccaacaatatcacaggagggtttacaccatcagcgatataagaagtaatgtcaccctctccctccagggatattatgaacaatatcacgggggggtgtgccccctctgccatataaggagtaatgttatcctctcattccctggatattacaaacaatatcacagggggatgtacataccctgcgatatggggagtaatattatcctctccccactgaatattatgaacattatcacggggcagtgtacaccctctgccatatgggaagttacatcatcctgaccctcattggatattttggagaatatgacttgtgggtgtgaccatcctgcaatatgggcagtaatatcatcctctccccttctggatattacaaacaatatcacaggagggtgtatactgcctgcgatatcgggagtaatattatcctccctcctagaatatcacagaggagtgtacactccctgcgatattgggagtaatatcaccctctcccctcctggatattacgaacaatatcacagatggtgtacacacagggtgtttaccatattgggagtaatatcatctcccttcctggatattatgaagaatattacaggggggtgtacacctccctgtttatgggagtaatatcattctcttccccttggatattagaaacaatatcacaggtgggtgtacaacccctgcgatatggggagtaatattatattctttctccctggatattatgaacaatatcacagaagggtgcacacccccggtgaaatggggagtaatagcatcctctcccctcctggatattacgaataatattataggagggtctatatcctctgccatatggggagcaatatcatttcttcccctctggatattacaaacaatattacagggggttgtacacaccctgcgatataaggagtaatatcattctctccccacctggatattacgaacaatatcacagaggggtgtacaccttctatgatataaggagtaaaatcatctttttttccctgtggatattaggaacaatgtcacagacagtgtacacacacagtgcttacgatatcgaaaatagtatcatctcccccctgaatattacaaacaatgtcacgggggggtccatcccctgtgatattgggagtaatatcatcttttcctcccctaaatattaaaaacaatatcacaggggaatgtatacctcctgcgatattgaaagtagtatcctcctctcccccacttggtattaggaacaatattacaggagaagtatacaccccctgcgatattgggagtaatatcgtcctcttgcccctggatattagggacaatatcacaggggggtatacatctcctgcaatattgggagcaatatcatcctcttcctccctggatattacaaacaatatcacagggggtgtacacaccctgcgatatgtggaataatgtcatcctctctattctggatgctacgggcaatatcacaggggattgtacctcccctcttctaatatcatccgctcttctgttgaatattatgaacaatataacatctggtgtacaaagtgacatgctattttaaggtggctgagaaattattaaaggagatcatttttctctctgcccctgaaaattataaatgatatcacaggggagtgtatgttccctgagatattgggagtaatattatcatctctgccccttaatattacgaacaatatcagcgggcgtattacgaacaattttatgaacaatatcacaccccctgtgatattgctcataatattcacaggaagggaggatgatattactcccagtattgcagggggtgtacattcccctatgatattgcttttactatttaggggaggagaagatgatattactcccaatatcgcaggggatgaacctccccccgtgatattgtttgtaatattcaggcgggagagaataatattctttttttcccttaatattatgaacagtatcacaagggcgtgtacaccccctgcaatattgggagtaatatcattgtttctcctcatgtatatttcaaaaaatatcatggggggtgtacactcccgtgatatttggagtaatatcaccctctttccccttggatattatgaaaaatatcacagggggggctgtacacccccctgggatattggaagtagtatcatcctcttcccctctggagattaggaacaatatcataggggagtgtacacctcctgtgacattgggagtaatatcatcctctcttctgttaaatgttatgaacagtataacatggggtgtacaaagtgacatgctattctaaggtgactgagaaattattaaaagagatcatttttggcaatgagactctttgggttggggcctcttcaatttgcacttggatttggtcctacctgtgggagaatctaacagtggtcctcctttgggggagcaagcagtgactgtcgaaggaaccacattgggttctctggactcctttatcatccctgatgcctagtctatgctcatggcccagccctacccccaggtcacctcccttgtcaggctcctgtgtcccccacacccacttgctgtttcatgctgacctggttagaaacactcttttttttttttttttgagatggagtcttgctctctcacccaggctggagtgcagtggcgtgatcttggcttactggaacctccatcttctgggttcaagtgattctcctgcctcagctttgtgagtagctgggattacaggtgtctgccaccatgccaagctaatttttgtatttttagtagagatggggtttcaccatgttggccaggctggtctcaaactcctgacctcaggtgatccaccagcctcagcctacaaaagtgctgggattacagtagtgaccgacctcccctggcagaaacattcttttgaccgcctcttggcaagctcttaggtcttcacatctctgatacatcattccctacgggggtttttctctgggtgactcagtggctctgtgcccctctccccaaccctgacacctgtccaggacttcagttttctgaggtttcctcccccttgtccaccccactcctctttcctgttacagatgaggccagatcccatttttaatgttctttagccctgacctgctcacacgagcttttggtttccttattgacctaagctgttgattctttatccttttatttgttgagggtgtcatcctttttgaattgaaaaatacagttgctgtatttttccctcttgattgagctttcttccctggggctctatatgttcagatagaactttttgccccagaagaggaaatgcggatttcattagtctgaagaagtaatttctcagctttgatttccaagttgaacccaaagcattaagaaaaaaaaaaaaaagcgggtggtggggaaggataacttcaaatttaggctttccaaaaagatgagatgtttgacttagaattctgaaggctgggaatgatttccttaaggagcccagcttggaggatggactttggaataatccagagtgggaggctgaggacaggatgtaaggaaagttctgtgccacgggaaggaaaagcacagacacaggcaggtgaggtttcatgagaaggtcaaggtgagagctctgctgtgtcttttgcggttgaaacctgtgcatggcggttggtgactcatttgaggaaactcactccctgggacttggaggggatctgacaaccccagggccaattcctgtatccttgagctgtgccctggagagctgagggttctcaaacaagctctggatgtgtgagccaagaccaacatggtgtggagatgcggagcggctggagtgaagggccgggtctcccaggaagccaaggagtgtggggaaactgaggcacagaagacgcttgggtttgtgtaaaagagttttcaggccgggcgctgtggctcacgcctgtaatcccagcactttgggaggctgaggtgggtggatcacctgaggtcaggcgttcaagaccagcctggccaacatggtgaactaaacacactaaacacacaaaacacactaaaacacacaaaaatttctactaaacacacaaaaatcagccgggtgtggtggcgggcgcctgtaatctcagctactcaggaggctgaggcaggagaattgcttgaacctgggaggcggaggttgcagtgagccgagattgcaccaccgcactccagcctgggtgacacagcaagactccatctcaaaaataaataaataaataaataaataaataaataaataaataaataaatagagtttgcagaattctgagtagctctgtgccccattgctccccctccacatctggccaagacttggatcttctgaggtttcctccccttcttctacccctacccatctctcctgtcatgacgccagagctcacattcaaatcttcctttgccctggcctgctcatgttgccctttgctttttttaaaaaaattgaaatgttcctcctgtcatgtgctattctttatttgctcaaagtattcgacattactgtgaaatgtcactggctgggcaatttcctcctgagcgctttggcttatcttctctgactaaatggaataaacctgttcaaatcagtatttttacatattgctcatccaatattgtacaggaaaaatactaatatggggccaggtgtggtggctcacgtctgtaatcctagcactttgggaggccaaggcaggcagattacgaggtcaggagatcaagaccatcctggctaacatggtgaaaccctgactctactaaaagtacaaaaaaaaaaaaaagggaaaatactaatatggggctaggcatggttgttcatacctgtaatgccagtgctttggaaggctgaagtgggaggatcacttgagtccaggagttcgagaccagctgggcaacatattgagacccctgtctctacgaaaaccaaaaaaaaaaaaaaaaaaaaaatgagccaggcatagtggtgcatgcctgtagtccttgctaccgagtaggctaaggaggaaggattgcttgagctcaggagttcgaggctgcagtgagctatgatttcgccactgcactccagcctgcaatggcctgaatttcctgttcagatcttttatgaaccaaatactacacaactgtagtcatgatcttcttggctggagagaggctggctgtcacccagggccacagggtgattaggtagaatgaaaagagagtcaccaactcaagacagtagcacagtgtccttgtggttttggctggtgtagtctaaaatctgaattatgcaaagtgtatttgatcttgcatcacatcaggaaaaagcccagtaatctatttcatcatggggtgtggagaagttgctggaaccatttctagacacagattttggttctccagaggccagcaagttagcttcactaagcttcggggcccacagtgggaagagatgtcctgctgaggctcagcgttgacttcactcttgtggagcaaagctgtaggaactaagggctttatgctaattaaaagatgaggccaggtgcagtggctcatacctgtaatggggtcttgctatattgcccaggctggtctcgaactcctgggttcaagccatcctcccacctcagcctcctgaatcactgggattaaaagtgtgagccactgtgcccagcctcccttttaatagaactggtgcttaatccacagctctcctgtcagcccacagttcttgaattttggcctcttttatgtccacatgaatgtaaatatacttcagaatttccacccagaatctttggaatctaatttcttcaatcattttactttagagtcatttttagggtaagtgaatctgcctggttttcaacttgacaccctctctaaacgtgaatgagttcaaatcatattcgttcctgaggaatcacactcaagcatagtacaaatctgtgggatatgccattacaactctaggaatcatgttctcaaggtaaaagcctttaagaaaagctgtcttgacatatcatgtaagcatgacaatggaatactaaaccaacatagctgagattttccttatgtcctatgcttttaaatgatcaaccctacagtcctggaaccaacctttatggttatcaatacctccattattttaaactatctcaggtatcatattccttcttttttttttttttttgagacggagcctctcactgtcacccaggctggagtgcagtggcgcaatctcggctcattgcaagctccacctccaatggaatactaaatcaacatagctgagattttccttatgtcctatgcttttaaatgatcaaccctacagtcctggaaccaacctttatggttatcaatacctccattattttaaactatctcaggtatcatattccttctttttttttttttttttgagacggagcctctcactgtcacccaggctggagtgcaggggcgcaatctcggctcattgcaagctccacctccaatggaatactaaatcaacatagctgagattttccttatgtcctatgcttttaaatgatcaaccctacagtcctggaaccaacctttatggttatcaatacctccattattttaaactatctcaggtatcatattccttcttttttttttttttttgagacggagcctctcactgtcacccaggctggagtgcagtggcgcaatctcggctcattgcaagctccacctcctgggttcacgccattctcctgcctcagcctcccgagtagctgggactacaggcacccgccacgacccccggctaattttttgtatttttagtagtgccggggtttcaccatgttaaccaggatggtctcgatctcctgacctcgtgatccacccgcctcggcctcccaaagtgctaggtttacaggtgtgagccaccatgcctagctttccttcttatatgtatcaaaactcatactgaaaaatgagttctgggttacaaaagagggtttattttttgcacctgcctttgaatcagtccttaagcttaacctttaacttccaaggaactacttttttttttttttttttttagatagagtctcgctctgtcacccaggctggagtgcaatgatgcaatctcggctcactgcaaccttcgtctcttgggttcaagtgattctcctgtctcagcctcctgagtagctgggattgcaggcatgtgccaccatgccctgctaacttttgtattttttgtagagacagggtttctccatgctggtcaggctggtcacgaactcctgacctcaggtgatccacctgcctcagcctcccaaagtgctgggattacaggcatgagccaccgtgccaggccccatccctggttattcttattcagtaaaatttgcaacctcctaggaagaaaggattttgaaaacaaaactcttttttaaaacttttattttaggtttgggggtacgtgtgaagatttgttacataggtaaacatgtgtcatcgtggtttgttgtatatattatttcatcacccaggtattaagcccagtacccaacagttgtcttttctgctcctctccctcctcccaccctcaagcagaccccagtgtctgttgtttccttctttgtgttcataagttctcatcatttagctcccacttataagtgagaacgtgtggtatttggtgttctgttgctgcattagtttgctaaggattatagactccagcttcatccatattccctcaaaagacatgatcttgttcttttttatggctgcataatatttcatggtgtatatgtaccacagtttctttagccaatctgtcactgatgggcatttaagttggttccatgtcttcactgttgggagcaagccccccaaaatctggccataatctggccccaagactggtcataaacaaaatctctgcagcactgtaacatgttcataatggccctaacgcccaagctggaaggttgtgggtttacaggaatgaaggaatgagggcaaggaacacttggcctgcccagggcggaaaaccgcttaaacgcattctcaagctgcaaacaatagcatgagcgatctgtgtcttaaggacgtgttcctgctgcagttaactagcccaacctattcctttaatttggcccatccctttgtttctcataatggatacttttagttaatttaatatctacagaaacaatgataataactggtttgctgttactaaatatgtgggtaaatctctgtttggggctctcagttctgaaggctgtgagacccctgatttcccacttcacacctctatatttctgtgtgtgcatctttaactcctctagcgccgctgggttagggtctccccaaccgagctggtctcggcacttcagtattgtaaatagtgctgcaatgaacactcatgtggatgtgtctttgttttttttttttttggagacggagtctagctctgtcacccgggctggagtacagtggtgcaatcttggctcactacaacctctgccacctgggtttaaatgattctcctgcctgggcctcctgagtagctgggattacaggtgtgagccactgtgcccagctaacttttgtatttttagtagagcccagggtttcatcatgttggccaggctggtcttgaactcctgacctcaggtgatctgcctgccttggcatcccaaagtgctgggattacaggcatgagctaccacgcctggcccatgtgtctttatggtagaatgctttatgttcctctgggtatatactcagtaatgggattgctgggtcgaatggtagttctgcttttagctctttgaggaatcgccatattgcttcccacaatgattgaactaatttacattcccagcaacaatgtgaaaatgttcccttttctctgcaaccttgccagcatctgtcattttttgactttttaataatagccattctgactggtatgagatggtatctcattgtggttttgatttgcatttccctaatgaccagtgatgttgagttttttcatatgtctgttggccgcctgtatgtcttcttttgggaactgtctgttcctctcctttgcccactttttcatggggttgtttgtttttctctcataaatttgtttaagttccttatagatgctagctattagacctttgtcagatgcacagtttgcaaataaaacaaaactcttaatgtcttcacttgccagatatttgtgcttaggttggtgtttgagtcttaggagtaatatcatgttttgccacaagaaggagcctatgagtgggctggaagagaaaaatcagatttgcagccgctgaagtcagtaaacagtttctttggatatattgtaaatagtaagagaaccagacatgacattcataagtattccaaaaccaagtaaaattattttaaagctctaacgttttgcaacttttcttcccgtcttaagagttcatctgcccagtctaatgattgtagaattcttacttctagtcttttttttttttttttgagatggagtttcactcttgctgcccaggctggagtgcaatggtgctatcttggctcactgcaaccttcgcctcctgggttcaagccattctcctgcctcagcttcccgagcagccacaatttcagggatgcgccaccacacccggctaattttgtatttttagtagagttggggtttctccatgttggtcaggctggtctcgaacttctgacctcaggtgatctgcccaccttggcctcctaaagcgctgggattacaggagtgagccactgtgcctggccatcatttatcttacttttagcatcctcatcccaaattcctggtgtccccatccctaccatccatttgtaataattctccattgttttcctctccttgaatcccactttctgagatcagtgcaacctgggcttagagcttcaacctcctccatctgattttttaaaagagtaactcctaataaggattttacccaatatagtgagcattatgattaatgaccctgactctacaaaaaataatttaaaaaaattagtcaggtgtggtggcgcatgcctgtagtcccagatactcagggtgaggtgggaggattgcttgagtccaggagtttgagatcacggtgagctgtactgcatcatcacattccagcctgggcaacagagtgagaccctgtttctaaaacaattaaggtaaaataaaagaaataacatgcacctggtacacagtacttaataaatcccgtctactgtaaatacctagtgcccatcatccctgtaactcataacttcttctttcccagttccccgtgctttaatcactcctgcttaggagacagtccaggctaccttcttatctctcttcctggagccagattctcagcattttgttctctaattccaccctttaccccttattgcatgccttggtatcagcacttcacctggtctgaggaaccagcatctagtcttgccctgtgtctggtagtccatatggcctgtatgtatcacttagtctgagtcagtttccacgtgtgtcagctggattagtagctccttagggttccgtgtagttctcacagtctgtggcaaggaaaacaacaatttgtgagtagctagcatggactgcaaactatgggctctatttaccaagcaagttctaaatgctgaacattgtctttggcaaaggggtttcagggaagatcaagaggcacatcttccctgccctcaggaaactcatataggctggttttgctacactgaattctcacaactcattgatgcaatgcagcctagaattaagttacttgctcattgtcaagcaggtagtgactagcagagccaccatcctgattctttcttagtttcttttttttttttttgagttagggtctcgctctgtcactcaggctggagtgcagtggtgccatcatagctcactgcagtctcactcctgggctcaagcgatcttcctgcctcagcctcctaagcagcagggactgcaggtgcacaccaccatgcccagctaatttttaaatttttgtagaggtgggaatcttgctcttttgcccagtccggtctggaactcctggcctcaagcatcctcctgccttggcttctcaaagcactggaattacaagcatgagccaccatgtccagccctaagtctgataccttctaagagggatcatcctcagatgagttgggtgtggaggtgagaggtcaggggtgcctggataagaagtgactctgctatcacttcctgtgtgagctgaggcctggagagaagatgagagaatgatggggaaggaggaagcagatgtgttgtggggttgggaaatggggaaatgtctgtgcatttctacttttacctttgatctctccttcagggctttgatattttcttcctgctaatcctccttttcacacctgcttggggctgccccatgagcttgtgaaaacagcatgtttctaccttccaaccacagtcctcagtgcattggccctctctctccttggcagagtctacgatgtttttcaaggttaccatgaagatttctttcttttttatttaattttaattttatttttttttgagatggagtttcgctcttgttgctcaggctggagtgcaatggcacgatctcagctcactgcaacctctgcctcccgggttcaagcgattctcctgcttcagcctcccaagtagctgggattacaggcatgtgccaccatacctggctaattttgtgtttttagtacagacaaggtttttccatgttggtcaggctggtcttgaactcctgacctcaggtaagccacctgccttggcctcccaaagtgctgggattacaggcaggagccactgtgcttggctttattttattttttaagttcctgggtacaagtgtaggatgtacaggtttgttacataggtaaacgtgtgccatggtggtttgctgcacgtatcaacccatcacctaggtgttaaaccctgcatgcattagctctttttcctaatgctctcccctaacctacatcctcccctgacaggacccagtgtgtgttgttcccctccctgtgtccatgtgttctcattgttcagctcccagttataagtgagaacatgcagtgtttggttttctattcctgcgttagtttgctggggataatggttttccagcttcatccatgtccctgcaaaggacatgatctcattattttttatgactgcatagtattccatggtgtatatgtagcatattttctttattcagtctatcatcgatgagcacttgggttgattccatgtctttgctattgtgaatagtgctgcaatgaacatatatgtgcatgtatctttataatagaattatttatattcctttgaggtatatacccagtaatggaattgctgggtcaaatggaatttctggttctaaatctttgaggaatcgccacactgtcttccacaatggttgaattaattcacattcccacaagatttctttcctgactttctgaacttggatcttctcctatcctccatccccaccacctggctccaggatcccagagactcagccttcctgcattcaaaaccatagtggaagaaggcctgattgctggggtgggcagtggcctgaaacctggggaggacttcactgggcctaaacattctggtgtagagaaagtcactaagtaaggacttgtgaaaatgtagaggactttgcggtgggggtgaactgcagagtcctactgtggggcagcaagaagtcaagaaggaggacctggcaactggggtcaagagctgcccacatgctcttcatgtccagccttttttctcctgtcagctttctagtgttgcatgctcatatgggcagaaagacttgccattatatgctagaaagcacatggtggaggctgggcgcggtggctcactcctgtaatcccagcacttcaggaggctgaggtgggtggatcacctgaggtcaggagtttgagaccagcctggccaacatggtgaaaccccatctctactaaaatacaaaaaattagctgggcgtggtggcaggcacctgtaatcccagctactcgggaggctgaggcgggagaatcacttgaacctgggaggcagaggttgcagtgagctgagatggcaccactgcactccagcctgggtgacagagctagactctgtctccaaaataaaaaaaaaaaaaagaaagaaagaaagtacaggaaggagaatttattagaaaattcaggcagcctgggcaacatagtgagaccacggcgctacaaaagaatacaaaaaaaaaaaaaaaaaaaaaggctgggcgcagtggctcaagcctgtaatcccagcactgtgggaggctgaggagggtggatcatgaggtcaggagatcgagaccatcctggctaacacagtgaaaccccatctctactaaaaatacaaaaaaaaaattagctaggcatggtggtgggcgcctgtagtcctagctactcgggaggctgaggcaggagaatgacgtcaacctgggagcggagcttgcagtgagctgagatcacgccactggactccagcctgggtgacagagctagactccgtctcaaaacaaacaaacaaacaaaaaaaaaccacacaaaaaaacaaaaaaaattagccaagcatggtggtgtacacctgttgtcccagctactcaggaggctgaggtgggaggatcacttgagcctggaggttgaggttgcagtgacctaagatcgtgctactgcactccagcctggatgataaagtgagaccctgtttcacaaagaaaaagaaaaagagttaaaaaaatccaggcatgaacaggaagggatgagcatggaataaaaccaggatgctgcctccgtaccaccagttctttgatttcaacttgttgctcagttgaatcattgccatactggtgagaaagaaatgtatttgctgactgttggtcaatattacagatttaaaacctgtgcactcttaagacctcaccagtttatagttttgtttcttccagatttctgcggaaagatgggcccaaggctggctttgctcccttttctctaggtcacacagtatcctaggccctgtgctgttatatttgactctgtggaagatgctttgttttcagttctgagccttttcttctgctgattccttctcaacctttgttccttgtgtcgctcaccctcccccaaaccaggtagatgcacccaggtgtggaaaagagggagggagaagaaagatcccttctgtcattgatacaggagctagaaaaaaattatttaggcagatagtgagggtaagagagtccgtggtaagatttccctttaatgaaaagcagcccccaaataatttcttttctaacaataagcagcctgaaaaattaagctgcaagcatagataagcaagctaaaagcttgcataggtaaatgccaacagctgtgccaatagaaaagggacacctggaagccaggtatattcaacatggaggtgccctcttccctttcctttgtcaacacgcttgcagtaaaaaagcaggcaacgtggtgatggccaagtagagaccccatctgcataataaaaggttaaggtgagatggccaacttgttggtgcgctatgcaaatggcacacctggtctgactaatctctcgggccctatgtaaatcagacactgcctcctcaagcttgtctataaaaccccccccccgtgcatttcaccacaaaaccggaagacccactcggaagtccctctctctctgcaggagagagagcttttcttttttctctttcttttgcctattaaacctccaatcttaaactcctccttgtgcgtctccaccttcttgatttccttggcgtgaggcaatgaatcttgggtattactccagacaaatgacgccacttcatcatcgttcttggggcacagaggtgctgagcttccacatttctcttcgctccctactcttgggtgagcccttcaccctgggtaccctgttgccccaggccttggcacgtgttgtcaacgtatggctgtgggaggaggctggtcttgtctggtgggaaggagagagacaaagagggcattgttgatagaagaagtggaatgagagctccctttacccttgggggcttcttttctggcattaatcctcagaaaataattgtgaaagagaagtttgtctttgtgctttagggtgctgtcagaagcttagaaataattaggcagaatccccatccccccaatccccatcaccaactttagtctcctcccccgatacccacactgacccagggttagggacatttataaatggagccattgaggactcaggagaaactcatgcaactgaaaaatgtcccctatttcctgggtcctaggcagctccccactttccactcccacttcagacatttagacaaggactttggtcactctggctagaccatctgtgtaacccagaatggtggggtcacaactcttggtttccaaggatataatcacatgttgtgagcaaaaatgtgctgaacacacctgactctgtggcttcttcttgagaagtgattttgcagagcggggaagggtcgactctggaaacgtttcatttgtctattggccatttggatttcttctgtgaagtgccttttcatgactatcatctatattctcttaagtttgtccttgttattgatttgtagttctttatatatccctgataacaaggcttgctttttcatgctctttatatatatttttaaaagcagctttagcaaagtgtaacatacaaaaatctgcacataaaatgtaaaatgtgatgttttgacatatatatatatgcactgaaaccatccctattaattccattgtgatcaaagacatatattgtatcacttaaatccttttacatgtatccaggcttattttatggtgtagaacatgatctatcttggtagatgttctgtgtgctcttgacaagaatgtattgttgcgtagaatgttctattgtcaattttgttgattaggtcaatttggcttatagtattgttcaagccttctatttgtttactgattttctgtctacttgtcctatcaatttttgagagatgggtgttggctccttaactattttgtgaatttgtctatttctccatgtatttctattaatttttgctgtacgtattttgaagctctgttattacgtgtgtaaacatttaggatttgataaatggactcatttgtaacaatcaaatatcttctttatctctggtaatattttttgctctgaaatctactttgatattaatatagtcactgtaggttacttttgattagtgtcagcatggtatattttccattattttacttttaaccttgtacctttataattaaagtgagttatctttgggcagcatactgttaggtcttgctttgtaagttaatatgttaatctctgcctataaattggaatggttagatcatttatatttaatgtgatgatttgtatggttaggtttaaacctctcatgttgctatttgttttctatttgtgccatttgtttgatctgttccccctttcctctttttctaccttctgttggattgagcatatatttatatataattttatttttacctccatgtttgtattattaactataaccctttttgggttattttaggcttatggtttatatcttcatgttattagtctacttcaattgatattatagcactcttcacacattgtaagaaccttacagtatactcccatttcttccctcctggcttttatataattgttaccatatatcttacctcaatatatgctataaaccccataatacattgttatcttttcgctttaagtgaaagattatctttgtctttatctttagagataaagtggggaagggttgactctggaaacgtttcatttgtccattggccatttggatttcttctgtgaagtgccttttcacgactatcatctatattctcttaagtttgtccttgttaattatctttatcaattatctttaaaacgatttaaataataacaaaaataatctttatatttaccctcatagttaccacttctggtgttctttattctctaacgtagatccaggtttctatctggtttcaaattcttctagctcaaaggacttcctttaccatttatcatggtgcatatatgttttttcattcactctggagatgaattcttccaactgttatatatcttaaaaagttttaatttttgcctcagcttttgaaaaaaaatatttttgagatagggtctccctctgtcacccaggctggagtgcagtgatgtgatcatagcttactgcaacctccacctcccaggctcaagctgtcctcccacctcagcctcccaagtagctggactacaggcgtgtgccaccacacctggataatttttgtatttttttgtttgtagagacggggtttcaccatgttgcccaggctggtcttgaattcccaagcttaagcaatctgcccacttcagcctcccaaagtgctaagattacaggtgtaagccaccgtacctggcctgaaaaatatttttgctgggtatataattctacattggcaatttattcctttgattactttaaacatgtttttccactgtcttctagcttatattgtttccaacaagaaagctactgtcattcttatctactgttggtgccctgtctagatgtccttttctgggctggcatgcccactcacaggctgttgttaatggtggctattattggctcatgaactctctccttttctaaatagatggcttggccgggcatggtggctcacgcctgtaatcgcagcactttgggaggccaaggcaggcggatcacgaggtcaggagatcgagaccatcctgactaacacggtgaaactctgtctctactaaaaagacaaacaactagccgggcatggtggcaggcgcctgtagtcccagctactcgggaggctgaggcaggagaatggcgtgaacccgggaggcggagcttgcagtgagccgagatcatgccactgcactccagcctaggtgacagagtgagactccatctcaaacaaaaaaaataaaaataaaaaaaagagatggcttcacccgggataatatgatttcttcctctccccgatggcatcccaatgccaatgactgaatgttattggagtacaaaagaacagcccttttacctcaagtggataaaatctgtggtatgatttatgcttcagggtcccctgtggacaagatcaagttcaaaccttacctgagatcacatttggcacagttttttttttttttacattaccttttctgcttcctctatttccttagagatttttactggtgagtccaacctaaaaaatcacatgtattcaagtctcttttaagttctgcttctaaggaatcaaacctaagacagtgggtaccaggagcggtcctaggaagcacaacataagaatgggattctagggctgggttacttgtcagccctctggcaagggggacagccatgttgatggcaggcatagtttctgacttgctttagcagtgcaagtgttaagacttttactcggaataactaggctaggacacaggtggaattagattcactggctgatgtaatgtgtctggcatttaagagatataagacaaattgcaagtataagggctatggagccaggtgtggtggctcacgcctgtaatcttagcactttgggaggctgaggcaggtggatcatctgaggtcaggagttcaagaccagcctggccaacatggtgaaaccccatctctactaaaaagtcaaaaattagccaggcatggtggtgggcacctggaatcccagctactcgggaggctggggcaggagaatcacttggcggaggttgcagtgaactgagatcacgccattgcactccagcctgggtgacaagagtgagactctgtctcaaaaataaaataaaacaaaacaaaataaaataaaataaaggactatggaattaggtggctattactgagcttcagtgatgccttaaagagaaaaaaatgaaaggctcaggacaataagtaatcaatttaaagcaaaatataagagttacaatgccttcttggcaacatttaaagagacccttatctctcgttgcctgaaggcagagagaccaggctgaatatttaactttaagagtggcataactacagagaagttcaaatttttcagcctagggaagtttctagtaccaaaaccaggacctcaataggaaagaataagaccctgagacatgggatggtgatattagatagatgccctttgaggtccttggatcatcagattattctggaccatttggacctgcagaagtggctcacactttttattggaagatagaggcccactcttgcttgaaaaccttgcaaaagtcttacactagacaaattcattgtaaggaaatgctggctcccctcaggatgtgttgcacctccccctttggccactagacccataacaaaaatcaaatcttagcatggcccaactggggaagtacttgacttactaaggagagggatggattagatactaaaggagcttcaagacttggacaacatgtgtcatcaggagcaaggaaaataaatcagagagaagattctgaagatcctggatcaaagggaggggactaaaaatagaaagctggatgtaggagtttgtcaatatagggcattcttatgggacacaggatttaacaccctagcaagtttattcttaggaggttgatatgaaatgatactggggtggcttttggaaagctggaaaacaacaagagcttctattaataaagttgagatgtcagaactcatatggaaaattgtgagtaaagggttcacagttctcagagaaatggatgtgggagaatagatctataacaaaagattggaaaatccaccaccagactctattccttgggaagtcctggataatactcattttcaccaaagaaataatgaatgtgctggtgatgaggagtttagaagctgtaagaatctcagtagtgttcatcctctgtagacggaggctgacagcagatgcccttatatactggatatactggttccctaatagcaataggaatgataggattctgaatcagcagaagctatttggcagcacttaataatcagaagcaaagtagttattattattataataatcaggaaggttgaaattatggccaaagggccttgaccttcagggatctgtggagatggctaatagaaaatagtgtttccatggagaaaatatacggttgcaaatgcatcacatttgctatcaacaaactccaagtaggataaactcaaagacatccatacttaggtacatgatgatcaaactgtcaaaagtcaaagaccagataaaacaacaacaacttaagagagaatcttgaaagtagcaagagaaaagcaactcattaaggacaaaggatcctcaataagtttaacagctgatatctcctcaaaaccatggaggccagaagacactggaacgatatactcaaaatgcagaaagaaaagggctgtcagtcaaggattctacaaccagcaaaagtatccttcaaaaatgaaggaggaattgagacaattctagataataaaaactgagagaatttattattagcataactgccctacagaaaatactaagagaagtcctacagactgaaatgaaagaatgctagtaagagatcatatgaagaaataaagaacagttgcaaaggtaatgacataggtaaacataaaagacatatacaaaactgaaagctttcctcctagaagaaggaacaagagaaggatgtgtgatcttatcacacctattcaacaacacctctagctagtactggcggttctatttagggcaattaggcaagaaaaaaagacatctagattagaaaggaagaaataaaactttgtttgaaaatgacataatcttgtgtagagaaaatcctaaggaacccacaacagcttactataattaataaattagttcagccacatcacagtatacaagatgagtatattaaaatcaattctatttctatacactagcaataaacaatacaaaaaggagaatgagaaaacaattcaatttacaatagcataaagaagaacaaaatacttagaaataaatgtaatcaaggaagtgccaggcttctacacagaaaacttcaagacattgttgaaagaaattaaagaaaacataaataatatatattccatgcttatggattagaagatttaatgttgttaacatggtggtgctctcaaattgataaaaaaattcattgcaatccttataaaaattccagtttccttttttgaagaaatagacaaacagatcctaaaattcaaacagaattacaaaagacccaaagtagataaaaaatattgaaaaagaagaacaatatacataaacataaattcaatcagtggaatagaattgaaagctgggaagcaaattcttaaatttatggccaatttatttttgataagagtgtcaagacaattcagtcgggaaagaacagtcatttcaacaaattgtgctgggacaactggatatgcatatgcaaaagaatgagattacctcacaacatacacagaaattaactcaaggctgggcatggtggctcacacttgtaatcccagcactttgggaggtcaaggtgggcagatcgcttgaggccaggagttctagacaagcctgggcaatgtggagaaaccctgtctctacaaaaactacaaaacttagctgggcatgatggtgcacacctgtagtctcagctgtttggggggctgaggtgggaggatcacttgagcctgggaaattgaagctgcagtgagccgtgttcataccactgctctacagctgggtgacaaagtgagaccctgtctcaaaaaaaaaaaaaatccatcatttattaagcactgaataatgttagtcaaacaggatgttaaactggaaattttgattgggatttcgagatgcaatgtttgggaaatacaacacatatcatattccaaagtgatttgctggtctgagatgcagcaattcaaaggaaaagcaaataaataaataaataaataaataaataaataaaggttaagctactcttaaaatctacacccacatcaaagttgtataaaatggcagagttgttggaaattacagggagagagaattaactttggagagaagatatctttgttttttttttttaaatttattttctttttttaggctagttgagtgaagcagtgggagtagagaaggaacaaagacatttgtaactggttgtgataaattgtttgaaaacagcactgcactttgaccagccaagagagaagatctttttggagagaggtgtgctgtgagttcttctccccaagagcaagggctaagggtgctgcccttggaatcttaagaccatcagcagatgaatggaagacgttggaattggcctgcatgcccaggttataaagtgtgatatggccgggcgcagtggctcagcctgtaatcccagcaatttgggacgctgaggcgggtaggtcacttgaggccaagagtttgagaccagcctggccaacatggtgaaaccccatctctactaaaaatataagaattagccgggcatggtggcatgtgcctatagtcccagctactcgggaggctgaggcaggagaatcacttgaacctgggaggtggaggttgcagtgagctgagattgcgccactgcactccagcttgggtgacagagtgagattccatctcaaaaaaaaaaaaaatagtgtgatatgatcactttacacaaaactagtctgtgacaagtggataaaaatagtatttcatcactattttactatttctttgattcctacctggactaaacatttacaggctttgaataaccttttctatgaatggtcttttcatgtctttgctaagtttacgtaccggtgcacttagaattatcttataatttgtataagctctcaatataattttagtaagatgcttttttgatatgctattttgtgctatttttttcctttgctttagagagaggtgccaagaaaatttctctttggaccttagtttctcttaggatgctctgcaggctgctccattctgggaatcataggaaggttgcaaggcttcccagaggcacttaggatagtcccctttcagtcaagaagcttcactggctggagaatgttctcaagaccccctccttgaatccatggagagcaccagagaattaggacatcttagctgctgcagggaccacagtcctgcagagccaattgctggcagcagatattttggacaagaaggtactagagtcctggagagagtctgaggaaaggaaggccatctgggaataggattttgggtggtggacgtctgtttcagtcctgggttatgaggatgttttgcacccaggaagtggttgttctcatgaatagaaaggactattgtgactgagcctcatgccttagtgaggggcagtatctggaaccgaggtgacatggtttggctgtgtccccacccgaatctcatcatgaatttccacatgttgtgggagggacctggtaggaagtaattgaatcatgggggcaggtctttcctgtgctgttctcgtgatagtgaataagtctcaggagatctgatgttttcataggtttttttttctgcacaagctctctcttggcctgctgccatccatgtgagatatgacttgctcctccttgccttcaccatgattgtgaggcttcctcagccacgtggaactgtaagttcactgaacatctttcttttgtaaattgcccagtttcaggtatgtcttcattagcagcgtgaaaatggactaatacatgaggttgcctctggcatctcctctgtgaagagtccagcattgaccctgagcactgtcacttcgaacacaggagaccagtccctctctgcacactccctcagccctgtgagttactctcctcactttgctgcttcccattcttggcggtatctctggagagactcctggctctagcagtggggctaggaatggccatggggacaggcgtcacagttctccctgggcctgacggagaggggtctgggttctctggattcctgaagggacgtggagcagattcccatcatgctgtggcggggagtctgtgctattctcccagccaagaggagaggacatcccgaaatcaccacaaattctgggatgaaggctgtctgaggaaatgaagcaaacacacacaaacacacaaagacatacaaatacacactcacacttatacatacgtgcacacacacattcttctgtgggtaagcttgtgcttcagctactttgggcaggagagcaggggggttttattctacctgtcattgccttcatgccccagtgctggaaacacactgaagccattgctcccccttcagatgatctgaaaatccctgtttcagttcactttgaaaacacccctcactctcaacaacagagggttggttattctgcagaactcattctttaacagcaggcctgctgctgctccagctgcaattcttttccccttcatgaaggctgccaggaatgaaaaggggagggaaaagaagtaggtggtggcaggaggctgggccagggaagtgtgggaccccacaggctccagcctgaggactcctctctcggcctctctcccctgttgtgaatgcttctgctgaaagccactgggtgagtgcagggacagagagccactgagctggctcagggcctcgtggtggtggtggtggtggtaggggggctgctctgggttctcgagaggcttctccaactctgacatgatcatacctgaggatattatcgaaattcagatatgacttaggaggcctgggatacggcccgagattctgcatgcctggtgatgccagtgttgctgctctgttgccacactggataaaagcatctagaaggtattccaggccagatggggtgggcattccctccctcataccttaactctttgacatggattctgccaccaacagaatcctggacgttttctcccaagagatgataagaaaaattcacaccaaaatcatgatggaatttcaaaatctgtttggatattagaaaatttctccaaaccctggcctttccttcctctcccaactcttgagctcacaggtgttgcttcactgactaaaatcctgacagagctccaattctactacctcccagacaactttatttgcaagctgtttctctactcagaaacaggggtgtcccttcagccgagcttttccaacaatgctgagctgggggctttggtacatctccccctccttctcagcctcagctctctaggtcctgaagtttgacctgggggccctgtccaccgtggggcaaagctgcagacttgttgatgagaggaggatgtgggtcttagggaaagagaaaggtgagctggggacagctggaccagattggagagaccacagggtccctgaaaagcagggggtaagggggtaggaggctatcatatagggaggtccctttggtatgcagactttgggacagaaagcacagttttgtctgaaccctccagaaggccctgaaagcatgggacataagcattgtgttggcgataacagctgcaggtgaaggcaggtgaatgacaaggaagggtgcttagggttagatatgagagctccaaaccaaggggccctgggcaggtccttttgttctactgttgcccctctctcctttccaaaaccccaaagctctgtggtgagctctggagacctcagctttgttctgagagcctctgagaggatttaggtgtctcttcatgggcctggggtgggaatgggagagacagaaagaaaggggacactaggtacggcctctggaaatgatttgaatccctgacccttgaaatatgtcagacccaccctgtgtgaaattccacgtctgctggaaatgtgacggaaatgtgtttagagggtgctggacctgcacttcgaaataaaacaaggctgacagcaagacttgagaatttacctaatgatc

SEQ ID NO: 204 - DNA, 371 bp, Homo sapiens
  modified_base (16)..(16): a, c, g, t, unknown, or other
  modified_base (299)..(299): a, c, g, t, unknown, or other
  modified_base (304)..(304): a, c, g, t, unknown, or other
atataatagtttattnaaagtccgtaatgaccttagccctccacatcattaaatgcgacaatatattatttactaaagttattaaccacctcctttgaatttgtacatatcagggacataagtgcttatgccaaaaagaatatagaaaatgcctgcaatctcattaacccatttccccctttaccatcgcagtctaacttccttcagaaagttccttaaaggaaaaaaaacaaatataaggaaccagaactagtttgaaggaaattccccaagggatctaattcaaacaggacatctanttcanaccatatatatgtggatttcttcatattattttcttggcattttatttttataggggttctaaccaa

SEQ ID NO: 205 - DNA, 3627 bp, Homo sapiens
atggagcggctgcgggacgtgcgggagcggctgcaggcgtgggagcgcgcgttccgacggcagcgcgggcggcgaccgagccaggacgacgtggaggcggcgccggaggagacccgcgcgctctaccgggagtaccgcactctgaagcgtaccacgggccaggccggcggcgggctccgcagctccgagtcgctccccgcggcggccgaagaggcgccagagccccgctgctgggggccccatctgaatcgggctgcgaccaagagtccacagcctacgccagggcggagccgccagggctcggtgccggactacgggcagcggctcaaggccaatctgaaaggcaccctgcaggccggaccagccctgggccgcagaccgtggcctctaggaagagcctcatctaaggcatccaccccaaagcccccaggtacagggcctgtcccctcctttgcagaaaaagtcagtgatgagcctccacagctccctgagccccagccaaggccaggccggctccagcatctgcaggcatccctgagccagcggctgggctccctagatcctggctggttacagcgatgtcacagtgaggtcccagattttctgggggcccccaaagcctgcaggcctgatctaggctcagaggaatcacaacttctgatccctggtgagtcggctgtccttggtcctggtgctggctcccagggcccagaggcttcagccttccaagaagtcagcatccgtgtggggagcccccagcccagcagcagtggaggcgagaagcggagatggaacgaggagccctgggagagccccgcacaggtccagcaggagagcagccaagctggacccccatcggagggggctggggctgtagcagttgaggaagaccctccaggggaacctgtacaggcacagccacctcagccctgcagcagcccatcgaaccccaggtaccacggactcagcccctccagtcaagctagggctgggaaggctgagggcacagcccccctgcacatcttccctcggctggcccgccatgacaggggcaattacgtacggctcaacatgaagcagaaacactacgtgcggggccgggcactccgtagcaggctcctccgcaagcaggcatggaagcagaagtggcggaagaaaggggagtgttttgggggtggtggtgccacagtcacaaccaaggagtcttgtttcctgaacgagcagttcgatcactgggcagcccagtgtccccggccagcaagtgaggaagacacagatgctgttgggcctgagccactggttccttcaccacaacctgtacctgaggtgcccagcctggaccccaccgtgctgccactctactccctggggccctcagggcagttggcagagacgccggctgaggtgttccaggccctggagcagctggggcaccaagcctttcgccctgggcaggagcgtgcagtcatgcggatcctgtctggcatctccacgctgctggtgctgcctacaggtgccggcaagtccctgtgctaccagctcccagcgctgctctacagccggcgcagcccctgcctcacgttggtcgtctctcccctgctgtcactcatggatgaccaggtgtctggcctgccaccgtgtctcaaggcggcctgcatacactcgggcatgaccaggaagcaacgggaatctgtcctgcagaagattcgggcagcccaggtacacgtgctgatgctgacacctgaggcactggtgggggcgggaggcctccctccagccgcacagctgcctccagttgcttttgcctgcattgatgaggcccactgcctctcccagtggtcccacaacttccggccctgctacctgcgcgtctgcaaggtgcttcgggagcgcatgggcgtgcactgcttcctgggcctcacagccacagccacacgccgcactgccagtgacgtggcacagcacctggctgtggctgaagagcctgacctccacgggccagccccagttcccaccaacctgcacctttccgtgtccatggacagggacacagaccaggcactgttgacgctgctgcaaggcaaacgttttcaaaacctcgattccattatcatttactgcaaccggcgcgaggacacagagcggatcgctgcgctcctccgaacctgcctgcacgcagcctgggtcccagggtctggaggtcgtgcccccaaaaccacagccgaggcctaccacgcgggcatgtgcagccgggaacggcggcgggtacagcgagccttcatgcagggccagttgcgggtggtggtggccacggtggcctttgggatggggctggaccggccagatgtgcgggctgtgctgcatctggggctgcccccaagcttcgagagctacgtgcaggccgtgggccgggccgggcgtgacgggcagcctgcccactgccacctcttcctgcagccccagggcgaagacctgcgagagctgcgcagacatgtgcacgccgacagcacggacttcctggctgtgaagaggctggtacagcgcgtgttcccagcctgcacctgcacctgcaccaggccgccctcggagcaggaaggggccgtgggtggggagaggcctgtgcccaagtacccccctcaagaggctgagcagcttagccaccaagcagccccaggacccagaagggtctgcatgggccatgagcgggcactcccaatacagcttaccgtacaggctttggacatgccggaggaggccatcgagactttgctgtgctacctggagctgcacccacaccactggctggagctgctggcgaccacctatacccattgccgtctgaactgccctgggggccctgcccagctccaggccctggcccacaggtgtccccctttggctgtgtgcttggcccagcagctgcctgaggacccagggcaaggcagcagctccgtggagtttgacatggtcaagctggtggactccatgggctgggagctggcctctgtgcggcgggctctctgccagctgcagtgggaccacgagcccaggacaggtgtgcggcgtgggacaggggtgcttgtggagttcagtgagctggccttccaccttcgcagcccgggggacctgaccgctgaggagaaggaccagatatgtgacttcctctatggccgtgtgcaggcccgggagcgccaggccctggcccgtctgcgcagaaccttccaggcctttcacagcgtagccttccccagctgcgggccctgcctggagcagcaggatgaggagcgcagcaccaggctcaaggacctgctcggccgctactttgaggaagaggaagggcaggagccgggaggcatggaggacgcacagggccccgagccagggcaggccagactccaggattgggaggaccaggtccgctgcgacatccgccagttcctgtccctgaggccagaggagaagttctccagcagggctgtggcccgcatcttccacggcatcggaagcccctgctacccggcccaggtgtacgggcaggaccgacgcttctggagaaaatacctgcacctgagcttccatgccctggtgggcctggccacggaagagctcctgcaggtggcccgctga

SEQ ID NO: 206 - DNA, 584 bp, Homo sapiens
  modified_base (17)..(17): a, c, g, t, unknown, or other
tttttttttttttttgntttttaatggtgtttttatttaaagcagcagaattggtagctaacagaatagtccctatgagtaacatgaagggcaaacgtcacatcaccatgttaacagactcgggaagtgtatctgaagaagtccaacctccattaatgaataacaattttcagcagacttctctgggggccttcctccacctgtgggagtcgtacatccagaagccgagtgagctggaaggaccccagtggggatgggctatggttggagaccctggtatgaaccccagtttagcttgacatagacacagatggttccatgcagaatatttatagacatgtatgtgcaaggattagcattcacacacattcccttgctctgtcagctgagaataaaaatgaggatcattattactattacattctcatctaggcctttaaatagcagctccagttgtaaacctctctaaggggctctggattaactgcgtgagagtgatgaggggaaaaggtctttctcatctccatctgacctacccatctaccaaccaagctggacactgactgtccttccgtcctctcccc

SEQ ID NO: 207 - DNA, 578 bp, Homo sapiens
tacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgatggtccactgtgctcccgtagagcccgttgaggttggcgtagtggcagttcctgtaccaccaggcccctcggtaggagacagcgcaggagatgagcaagctgttggggtcccgatcacgggcagagaagacactgccgctgtggtagctcatggagtcccctgcggtgccgtggtagccctccaagtggaggcggtagtactccgcagccgagtctacgtggaaagagtcgtactgggcgaacacagcctcgttcccagcccgcaggtccacgcgcatggagt

SEQ ID NO: 208 - DNA, 571 bp, Homo sapiens
  modified_base (504)..(504): a, c, g, t, unknown, or other
tttggtgttgagatgctgtttatttatcaaggtttacatgtacaaaattataataaatcatagtaatgaatattgcatcttttagtaataaacttgtttataacagtagttttctctcttttcagaatttaggacctttagaaaagttactctctggaaaataatattttatttaaactctggcattaaaaaaactactctttggaaatttaggcatgacttttaatgtatacattctgtttttcttattatttctaattttcaaaatagtaacatatattctgatcccacatcttaaaaatcctgaagagaaataatgaaaccatttaagttaacatgtacaccattttcttcatatactgcagaccaagtattaaatgttccatgtgggccagtcacactgtgctaagcactttatatgatttacttatataaatcttcataataattctattaagtaggggtaatttttactcctattaattggtgaataaactaagattntaaaatattgcccaaaattacctagatttgtgtcagaactcgtgtttgaacctaagccatttgactg

SEQ ID NO: 209 - DNA, 500 bp, Homo sapiens
tttttttaaatatttaagagtttatttgagcagtgatccatgaattgggcagcttcaagccagaagtggctagggagctccccagagagaacatgaggaggaggctttttaggacaaatagataaaagcaaagataatatttcattggttacagttatacagttacacagttatacagttgccttatttggtctatcccatgaggaagtcctagttactaattacgtttttgttggctgcttctgattggttgagcttaagttctgtgtttctttaacataggcatttacaagaaataccacaaataaagtttcagacatgcttgcaaatcaagcaaggttaaggtcacttaggaggcccaactggctctgtctgctcaaggattcttctggcctcgtctccattttacatgaactgttgcataaataaacacagagtacctgaaacaacggaggtgatcattctgcctaccgagtgttggccacgccaagcttggagtg

SEQ ID NO: 210 - DNA, 419 bp, Homo sapiens
ctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctcctgaaatgacagcagggagacttgggtcggcctcctgaaatgatagcagggagacttgggtgaccccccttccaggcgccatctagcacagcctggccctgatctccgggcagccaccacctcctcggtctgccccctcattaaaattcacgttcccaccctgaaa

SEQ ID NO: 211 - DNA, 424 bp, Homo sapiens
ttttttttttcaggtttaataaactttttaatgaatatttcagacataacaaaaaactgcagagcttcgtacacttgatttaaataattcttgagggattttataaggtcatcttatagacaaaattatgagaaaccagtgtggttatcaatgctttcagaatacttgtgtttatgtaaatataccccagagtccaaaactctgatatattcatatatattcacaatgagaggatgtctgtgccaaatctgtcaatcagtacaatagaaaagttaattatataactacaacacgaaacacaaatttttagaagcaaattatgtcctgtaatttacccccctccccgctgctcctctgctaactcattttcctcttttcccactctaaatgtaaggcaacccttggctttggagaagcatctgtt

SEQ ID NO: 212 - DNA, 2545 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 213 - DNA, 1519 bp, Homo sapiens
ggcacgaggaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgaaaaaaaaaaaaaaaaaaaaaaaaaaaa

SEQ ID NO: 214 - DNA, 3128 bp, Homo sapiens
ccttgtgcatttggtctgaagacaaagatgactgcaggagtgggcaggccggagtgggggtgacctggcctgtgccaggaaggaggaggagtctgcagccctgtgcggttcaacatccatcaaggagtccagagcaggagccaggccaggcgggagggaaaggccctgggaggggctctctaatctcccagccccgactctgccccgtcactgccgctgctcctcattactcgctggggctgctgtcgcctccccgaagggtggccttgtccagatagtggcaaacctccctgccgtggatgagtcaggagcattttcttaagaggaacatcactggaaaacaaaatgagcggggacacagaaaccaacagcagtggctgcatttgtggtacaggctcctcttccagagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcctggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttgggtccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatccgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgaaaa

SEQ ID NO: 215 - DNA, 1483 bp, Homo sapiens
gggcgaaaatggcgtacattcagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggggcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaaaaa

SEQ ID NO: 216 - DNA, 428 bp, Homo sapiens
gcggccgcaaatcttttttttttttttttttttttttaaacccctcggtttctctttttcttctctttctctcttgtttttggttaaaaaaaaatctagatctcttaaatctcacacatctctgagggttcctataggcctgctaggccttaattctggattccccctcctcacttgcccctgcgacagggcaggggaaagtggtgggggacaccccaggatcctcagtccttagtcctacagcttcttcctttcttgttaatccctttctttgtttggctctgccggctcccctgagggggagggggagagggggaggaagtccatggagtgaaatccaatctactggaagggtcccaggagggaccgggttcccccagctcctctctccaccattcacccccgggatgctcccccaagaaaagcaa

SEQ ID NO: 217 - DNA, 583 bp, Homo sapiens
ttttccggaaaacgaccaccacagatttttatttaattaaaaatattatacatgttgttgcattttcatggaaaatattgagttaaaaacacaagcagtgttaattttcagaaaccttcatgcaccccattctgccacctgctgccttcttctgtccatggcattaaccacatgtttgtaagaattgggcccatcgaactggagcttcctagaaggtcatacctgtgggtctcctggagtaagccattgtcttcaagacagtgttctgtcaagtcaactcagataccaccagctgtggcttccttgcaaaccattgaaaggaactggtgtaaaagccccaaagcacatgtcaacaccaactcagcacaattccacgcaatcaagcactgctatgacctcatccagtttccaagctagttagcaaatgaccttgtgttctacctggtgtattagtgtcctgagctcctccacaaaacttccctgggacccaaggtggaaagacactgccatatagtgtttatattcaaaccattaacaaatacacaaaaacatacgtggctctatgcacaatactatcaaatta

SEQ ID NO: 218 - DNA, 527 bp, Homo sapiens
  modified_base (459)..(459): a, c, g, t, unknown, or other
tttttttttttcaaagaaacactagcaatttattgattttctctatttccaaaaaaagcaaatacattagtgtatcacacaaggaaactgggcctggccggcacaaggttcctctacaaacatgaagcaaggggaaggtgggctacagggaagctccaagatccctcacagaagcccccggtttcccttccctgcccaccccagccgcagttttggtcctcccagccagttcagccagattccaaggtggacacgcagacagcaacactgcctcttgcccatgaggttcaggtaggtgcggatggcatctgaatggtacaaccagccgctgcccttggggttggtcttttcctcaggcagggggcagtcatagttgttgttcatcatcttgtcgctcttgttgctgaagcagccagtggaggacttctcggtgtaggcgttgcgggcgttatactccanctggcgtagcgggtgggacatcggcgtccaggcggaggagagtttggcaaaacacacatgcagttttc

SEQ ID NO: 219 - DNA, 4792 bp, Homo sapiens
ggaccacccagtaccgatcccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggcctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagcttt

SEQ ID NO: 220 - DNA, 2505 bp, Homo sapiens
gcttccggctccggcgtggggtttgatgtctacggagtggcttttgcttagcgtcttgaaggggggaaaaaaatcctctaagctggtgatttcacgttctttgacaaacttcaatagcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatctcatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaaggtaaagctggaaccagtactaacacgagactaggctctccctcccctctccaaggccaatttctctcccttgtggtggttcttttaaatgaaactttagaagtggcttgtttagataggatgacatcacttttgtggtagatctaacctgatactttttgggtaaaagacatagtaagcctcttagacatacatattttttaaatgaattatcagtttttactatgcaaatatttttaattttttacgtagtacaattgatcagtcctttatgtttgcggtgctctctctatactgagtttatagaggaattctcttacactttcttcaattgtcattcttctttaaatttggagtttatttgtgtggatggcatgaggaatggatctaatcttaccttttttccaaatggccacccagttgtccagcaccatttaattagagagcccatctatgctccagtgacttcagataacaccttcatcatatactgattttccttatggacttaagtctatttctagatttctcttctcttccactagtctttctgtttattcatgtgtcaatatttcagttttaattacagagattttatagaatgatttaatatgtgataggagtagacaccccttatggcttttcttttactagaatatcaggtgttctagctattcttccgtgtttatttttctacatgaatttttgtatcaatttgtctaactccataaagagcttactagtatttttattgcattatttataaataaatcttgtgagaattg

SEQ ID NO: 221 - DNA, 536 bp, Homo sapiens
aacgtttgtttcatattttattgaatttcatttatattaaattaaaaatatatttctgacagattcatgtaacaaaaaggcagaacagttttcaaattgttcagctgggatgatcagtatggaatgaggcaaagcagttcgcattctataattgccttgtacaggtacaattctttcccaagagccaaaagaggatccttgagaactaacggaaaagcctaattacataaatgtaaaatactgtttctccctcattctcaaataacaacaggaatgagggaaaggaaggaggatgggtaaaaggttggaggagaagaaagaataagagaaagtatactaaaaatatgcctaacattaaaaaagttagtatgtgttaggtgcatgatccttcatcaataacatggaaaaaaatcaaaataacattacaccacacacaattggcatatcctattgtgtaagcgagtgcagaggttgaacacatcacaatagtgctgaacacagaatcacaagtaatgtcaaaatgataacttccaacc

SEQ ID NO: 222 - DNA, 538 bp, Homo sapiens
ttattatttattactattatttttattgttagttttttagttataccttctgggatgggagacagttttaaaagttaacaattgtcttggatgttgctgtttttaactcagtaagtacatctgttctgccagtgctgccctgagcactggaactgggagagcaggtagcaagctagcactggacacagcataaacagcgacatatttctcttccccttcaaactggctggccctgtaaccaataaaatgtggcccatgtgacactgggtgacttctgaggctagccctccagagatctagcttatgtggtcctttatttgggaatgctccttctcgtaatccatctgccatgctatgaggaagtccaagcagccatatggagagccgcaggtgcaggagaactaaggccccagctaggagcctgcaccgcattgctggctgagcaagtcaggccagtttggacttttcagccattccagggctccatccaataccatctaaagcagaactggctggtcaatccatagaaggaaggggg

SEQ ID NO: 223 - DNA, 4186 bp, Homo sapiens
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactc

SEQ ID NO: 224 - DNA, 251 bp, Homo sapiens
gcggccgcctactactactatacggctgttagaagacgacagaagggcagtgactcgacaaaggccacaggcagtccaggcctctctctgctccatccccctgcctcccattctgcaccacacctggcatggtgcagggagacatctgcacccctgagttaggcagccaggagtgcccccgggaatggataataaagacactagagaactcaaaaaaaaaaaaaaaaaaaaaaaaaaagtcgtatcgatgt

SEQ ID NO: 225 - DNA, 554 bp, Homo sapiens
  modified_base (540)..(540): a, c, g, t, unknown, or other
acattttgttgttgctgccgatgatttcaacgcctggctttgagattccgtgagtagtcttgaataatttaaaattcgaaaatcaaattctacttattttctcttaatgctattgtatttcctaattctcagctttaacatgtaagaaagtactttcgctaggggtcttaattgaatggtggggtcgagatgactgcgtcagaattaaatctctggaagacctctgagctccttttaaaatcatcaacaagcgaaaatccttatcaatagcgatgtgggaatgcattaggtacagtattttaaacatacaaaacctaggcatattaaaaagcactcctctggtaatttaataaggaataatgatgtccttaagtttattttaatcagcaagtatgactcaatttgaaaatatgagaacaaatagatttaaataggaacacccagtaaactatggtatgcaaataaactcagaggtaaacttgtgaatacataaatctaaataagtcagttaccatcaaaatattacgtgatcctatattnttctgtccacgtct

SEQ ID NO: 226 - DNA, 12680 bp, Homo sapiens
cctcccgcctcagttcgcgccgcgcctcggcttggaacgcaggagcgccggctccgggagcccgagcggagccagccgcgcgcacagccagcggccgcgccggcgatgcggggccaccccgcgcccgccccagtcccggccccggcccccgcgggaaggggctgagctgcccgccgccgcccggatggcgagcctcgccgcgctcgccctcagcctgctcctgaggctgcagctgccgccactgcccggcgcccgggctcagagcgccccaggtggctgttcctttgatgagcactacagcaactgtggttatagtgtggctctagggaccaatgggttcacctgggagcagattaacacaacggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccaggggctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgttccaggagctgttcctctagaatccatccaaggggggccctttgaggagaagatctacatccagtggaaacctcccaatgagaccaatggggtcatcacgctctacgagatcaactacaaggctgtcggctcgctggacccaagtgctgacctctcgagccagagggggaaagtgttcaagctccggaatgaaacccaccacctctttgtgggtctgtacccagggaccacctattccttcaccatcaaggccagcacagcaaagggctttgggccccctgtcaccactcggattgccaccaaaatttcagctccatccatgcctgagtacgacacagacaccccattgaatgagacagacacgaccatcacagtgatgctgaaacccgctcagtcccggggagctcctgtcagtgtttatcagctggttgtcaaggaggagcgacttcagaagtcacggagggcagctgacattattgagtgcttttcggtgcccgtgagctatcggaatgcctccagcctcgattctctacactactttgctgctgagttgaagcctgccaacctgcctgtcacccagccatttacagtgggtgacaataagacatacaatggctactggaaccctcctctctctcccctgaaaagctacagcatctacttccaggcactcagcaaagccaatggagagaccaaaatcaactgtgttcgtctggctacaaaagcaccaatgggcagcgcccaggtgaccccggggactccactctgcctcctcaccacaggtgcctccacccagaattctaacactgtggagccagagaagcaggtggacaacaccgtgaagatggctggcgtgatcgctggcctcctcatgttcatcatcattctcctgggcgtgatgctcaccatcaaaaggagaagaaatgcttattcctactcctattacttgtcccaaaggaagctggccaagaagcagaaggagacccagagtggagcccagagggagatggggcctgtggcctctgccgacaaacccaccaccaagctcagcgccagccgcaatgatgaaggcttctcttctagttctcaggacgtcaacggattcacagatggcagccgcggggagctttcccagcccaccctcacgatccagactcatccctaccgcacctgtgaccctgtggagatgagctacccccgggaccagttccaactcgccatccgggtggctgacttgctgcagcacatcacgcagatgaagagaggccagggctacgggttcaaggaggaatacgaggccttaccagaggggcagacagcttcgtgggacacagccaaggaggatgaaaaccgcaataagaatcgatatgggaacatcatatcctacgaccattcccgggtgaggctgctggtgctggatggagacccgcactctgactacatcaatgccaactacattgacggataccatcgacctcggcactacattgcgactcaaggtccgatgcaggagactgtaaaggacttttggagaatgatctggcaggagaactccgccagcatcgtcatggtcacaaacctggtggaagtgggcagggtgaaatgtgtgcgatactggccagatgacacggaggtctacggagacattaaagtcaccctgattgaaacagagcccctggcagaatacgtcatacgcaccttcacagtccagaagaaaggctaccatgagatccgggagctccgcctcttccacttcaccagctggcctgaccacggcgttccctgctatgccactggccttctgggcttcgtccgccaggtcaagttcctcaaccccccggaagctgggcccatagtggtccactgcagtgctggggctgggcggactggctgcttcattgccattgacaccatgcttgacatggccgagaatgaaggggtggtggacatcttcaactgcgtgcgtgagctccgggcccaaagggtcaacctggtacagacagaggagcaatatgtgtttgtgcacgatgccatcctggaagcgtgcctctgtggcaacactgccatccctgtgtgtgagttccgttctctctactacaatatcagcaggctggacccccagacaaactccagccaaatcaaagatgaatttcagaccctcaacattgtgacaccccgtgtgcggcccgaggactgcagcattgggctcctgccccggaaccatgataagaatcgaagtatggacgtgctgcctctggaccgctgcctgcccttccttatctcagtggacggagaatccagcaattacatcaacgcagcactgatggatagccacaagcagcctgccgccttcgtggtcacccagcaccctctacccaacaccgtggcagacttctggaggctggtgttcgattacaactgctcctctgtggtgatgctgaatgagatggacactgcccagttctgtatgcagtactggcctgagaagacctccgggtgctatgggcccatccaggtggagttcgtctccgcagacatcgacgaggacatcatccacagaatattccgcatctgtaacatggcccggccacaggatggttatcgtatagtccagcacctccagtacattggctggcctgcctaccgggacacgcccccctccaagcgctctctgctcaaagtggtccgacgactggagaagtggcaggagcagtatgacgggagggagggacgtactgtggtccactgcctaaatgggggaggccgtagtggaaccttctgtgccatctgcagtgtgtgtgagatgatccagcagcaaaacatcattgacgtgttccacatcgtgaaaacactgcgtaacaacaaatccaacatggtggagaccctggaacagtataaatttgtatacgaggtggcactggaatatttaagctccttttagctcaatgggatggggaactgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtctcctgttgccgtgggagatgctgctccaaaaggcccaggcttccttttcaacctaaccagccacagccaagggcccaagcagaagtacacccacaagcaaggccttggatttctggctcccagaccacctgcttttgttctgagtttgtggatctcttggcaagccaactgtgcaggtgctggggagtgggaggctcccctgccctccttctccttaggagtggaggagatgtgtgttctgctcctctacgtcatggaaaagattgaggctcttgggggtcactgctctgctgccccctgcaacctccttcaggggcctctggcaccagacatttgcagtctggaccagtgtgaccttacgatgttccctaggccacaagagaggccccccatcctcacacctaacctgcatggggcttcgcccacaaccattctgtaccccttccccagcctgggccttgaccgtccagcattcactggccggccagctgtgtccacagcagtttttgataaaggtgttctttgcttttttgtgtggtcagtgggagggggtggaactgcagggaacttctctgctcctccttgtctttgtaaaaagggaccacctccctggggcagggcttgggctgacctgtaggatgtaacccctgtgtttctttggtggtagctttctttggaagagacaaacaagataagatttgattattttccaaagtgtatgtgaaaagaaactttcttttggagggtgtaaaatcttagtctcttatgtcaaaaagaagggggcgggggagtttgagtatgtacctctaagacaaatctctcgggccttttattttttcctggcaatgtccttaaaagctcccaccctgggacagcatgccactgagcaaggagagatgggtgagcctgaagatggtccctttggtttctggggcaaatagagcaccagctttgtgcataatttggatgtccaaatttgaactccttcctaaagaaacccagcagccaccttgaaaaaggccattgtggagcccattatactttgatttaaaataggccaagagaatcaggcctggagatctagggtcttgtccaaagtgtgagtgagtcaatgagagggaaccaacatttgctaagtctctactgtatgccagggatcatgcttggcactttccataggacatttcacacagtccttagaacccccaggagagagctactgacttgttatcatctccatttgatcatctcctccaatgaggaaacccacgcaccttccttagtaatgaaatcctgggttccaaaggggcaggtaatggcaatgagacttctccgtgctgttttcttcatcttctctaagccaagcaattattttatggagggaaaataaggccagaaacttctgagcagataactccacaaatggaaatttagtactttcttcctgatgccagttcttctgggaagcgcagaatttcagatatattttagtaacacattcccagctccccaggaaagccagtctcatctaatttcttagtcagtaaaaacaattccctgttccttcaggctatgaatggaccagccagggaaactctcgaccttgatctctagccagtgcttaggcccaatatctgacagcctcaggtgggctgggacctaggaagctccatcttgaaggctggtctagccccagacagggcatgaggggcagagaattcaagaaggtacagctttggccctcaagagcccactgtatgctggggaaatggaaccatggtgcagtagtgtggagtggatgagtgttccatgagcctaggagcaagaaagtctcttcggcctcgggcttcctggagaaggggacgtccattcctgctgggtcttaacaagcataaaaaggaaaaaaaggaaactcaggcaaagggatccatatgtgcaatggcaaagaaatgtgaaaaggcattgggagaagcagtctgggggaggccagcccagtgcgggcacagcacaacacggggagcagcaagagatgagccagggtccaggagacagatgcccatcgcgagtacagactttgtcctattggcaacaaggagtccatggagctttagagagatgcactcagcttcgtgttggccaagactccttctgggccaatggggctgcctcttttcctttcatcagacactgtgaaaacattcccttaagcgtgcactttttaatatcacatctatttgtctgtctgctcattgttttgttgctggaactaaatatgcaatggatcatgagactcagattctatgagaaacccagggtctctgctttaccacggagcagggtcaccaacccagatctccaggcccatgaggatggaacatgaaaggagccgacaaaagttgcttccattggcatgggctctggagctgtccagaagtccagggacaccagacttgatcaaggaagggctgtcactttagaggttcaaaaggaagtgcctcaaagcaaaggcaagcaaaggaaccccacgatgaacttgctcttttcctttgatgagcctctccccaggtgtatttcagcagaccccggggacccacccccactgggcctgctggcctccctcggctccagcccaatgccccagctggccttccccagcctgcaaggagcctgtagcatggcaaatctgcctgctgtatgctattttcttagatcttggtacatccagacaggatgagggtggagggagagctatttaacacaaatcctaagatttttttctgctcaggaaggggtgaaatagctggcagatacaaaagacagtggcttttatcattttaaatggtaggaatttaaggtgtgacttcagggagaaacaaacttgcaaaaaaaaaaaatctcaggccatgttggggtaacccagcaagggccagtgatgatttcccccagctcatccccttattttcccacaacccaaccattctctaaagcaggacagtgaataggtcttaggccagtgcacacaggaagaaattgaggcttatggatggggatgacttccctaagatcccatgggacaaggatgtggcaaggcttggatgagatggggcaccagtgcccaggaatttgaacattttcctttacccaggaaatctccggagccaacaccaccacccccagggggtctccccaccccaccccatttacagggtgagctcagcctgtcatgagcagaggaaaatattattaatgctctctgagtctttacaacaggagctcttacctcatagatgtgggctctgtttggggaagatgcaaggaagtaatgagaagcccaggaaatttctccacctgtgtttatggcctaaatagcttcaggatgtatcttagctgcactccaacattgcatcctttctggggtgaagaatctgggccaaccaggggtccttgggcctctagaaggccacagtaggcctctctttgtgggaatggaaggggacagtttgcttttagtgctggccctctctgtgggtgtggcctgcaaaggaaccaacagaccctatgctggggactctaacatgtgagctcattaaattcttccagcattctaaaggagggtttgtgattgtcaccatttactgatgaggaaactaaggctcctaggggagaaatcacttgcccacagttccacagctagtgagtgaatgaaccaggatttaaaccggttttttctcactacagagacaatatttttccaccattgtatctcacatttttcccaggaggttacccataacagaagagactagagtggaacagatacgtcagtggataaagctcaaagcaaacaacagtaagcttaaaattccttcatagtctcatgttttacgttcacaattcatgcaaaatttgcattccactttctgatttagccttgttggttttaatatgactctatgaatatttcaaaaaaaaatgtgctctgttcctcatgttgttctgttctgttcaccccgctatgacggaccctaggtcagctggtcttcagcttgaccctagaattgactctaggagcagtgaccctgctgcctcccagagccagttataggctcaagatcaagaccaactgaccttctcctaggcagctcctttggtgtgtgggtgctctgacctcactgttcatgaggggacctcaactaaggcatcttccagttgggtgctggaaggaacccattaactcacactagaatgatgaggatttgctcatctggcgtggagaaggatgagcccacaaaaccctaaagggaaaagagaagctggacacagctgtactcagcagattcctgaatgctaggctggaaagtggtgcctgttgtccaagtggagtcacatggttgctaatgtgggcaagtctgaggacacacttcatgagcagctggggtctggaaggctcctcactttaccctagccacacataattactgggtgcctacagcacctagcaccttggagggggcactattaggaaatcgagattactatggcacaattaattcctgggtaaggcatggggttgtggtggacagagctcagtctttagtttgaacgaaaacatacatacatgaaaaacatacatgaaaaaaggaccctcatcaacattagaaggggtagatttggagcactttaggcaggaaaacaggaacgcaaggccaggaaactggaacccagtgaatactcagaaccgaggatgcagatgacttatttagcaaaatggtcacttctgtgacatagctggagaaaggatgggtaacagcttgccagagccacttggaacaagggcaaatctcagtgtctggggcaaaagatgatgcatttccctctgacccatcatgtttattcatcctccactccccattgccacactagctcttgctgtaagtcctcaccaggatctacatttcctcgtcgctggtgggaaccccttagagtacatagaggtatcagtccagtaagactgctctacacaacagaagtgaggcccagggagtagcagccaggcccttatcctgttacctctgcaggagtgactgcccaacccagatccagagacattgaaggaaatgataattccttggtacctcactgccttgggacaaaatgaagaaagccacccttccttaggctgcagcttgccactcctgggctgggtaaacaggtcatcagcaccaggctcaaccaggagtaacattctggaagacatgggtgagcccaagaggaagcatgaacaggacgctgttcctaagtcatgtcaacaggttgtgctgggccaggatccccagggaaaaaaatggtcaacccaactggagggtaggttagaagaaaaaaaacataaacgtggatagtcatgtcatctcaaatccctgacttggcttccccattacttgacagtctgagctccttcttagcctgtgaccagcttcaaatcacagccaagtaaaacaaggaaataggaaaagtaaatccaactagaagagacaagctgagattcagatttgtttactcctcccatgcaaagtttccctgttggaggttttccatgtatacatgtctagaagtgatagaatgcaaggccttggctttgtcttgcagggatctgcctttgaggtcatagactgaacagcagggagagaggttagtggtggagtgtggggggagctgttctagctccagtttcttctgacacatttttcaggatcatggatctgatcctccgaagcacagcagagatatctaagccatatttgtgcacatgagcagactcttctagttttttagtaaccagggatgggcttttgcatggcactgactatagagatgtcttgtagagatcaagccagtcttttgcatcccacctgcccacctccagaagagatgggaaaaggtcatcaaagggcattcaccaactgaaatccactcatgaatgttaggtctctaaaaggaggcatcaacactcacaatggtagcctccaaacctagcatcccacctatctaagagctcaggggtggtccactggggcagatacaagggaagtgcaagggctcaggatgaaagaaaatctattgggaagagttttaggggcttgatcattatggggcttccttctatatctgagaactgctctgggtggtgagatgtggactctgatccttaattggaatgttcggagaatgagtgtctggtggccttgaagtgttggacagaaaagtatcagtataaaagcctggagctcagggtaattaatgtagttcatggttccttagtgagcaggactcttggatgtggaggagaaagggtcataggaagtaaaccaccaaaattacaaaattgagtctctgtacaattacttcagtgcctttgggcttatgaatacaaatcagtgggccttctctatgatggtccaacaaactctcagtgtccaccctgtccctgtatctcccatggaagatgaataatgtcaggtgttctttgggtcaaaggccccagggcagtctggaggcttagagggcagagtggtgtcattccatgtaaagttaggcttctgaggggtcaggcagaatatggtgtccatatcttccatagctctgcagattcttggatgaagtcaagcacagtttgctagacccaggtcactcctctgagtataactaggacccatgagtgaaacttaatagctgtaaggaagaacctgctgtctgccagagaggataagctgcccatctcagcagctgtctaaaagaaggcaggtgtctctttaaagggaagagaagcattggtgaaatggatttcaggtcacttccattccagatgggtgagatcttgtggagctgggatcatgtttgaactcattcatacctgtagagcacgaatccaagtagattgtgtttggtctgtacaggctgaagccccctgctctcccacccaagtgcccccactgagcaggccaacatgctgttgtggccacatatactgggctgatccaggctggttatcaccaaacagcaaaccatagggaacagctgctttgccatagacccaatacccatgtagatctctcatgagagcagccataactcagacccactgaccaacagggccatgagtgacagccagaaccagtgaaggtccaagtaggacacagagcagggcttttcttaccatacacattatctccagaggttatttctaccccactccctattcaaggcctgttggagcacactgcaaaagcaaaagcacagtaactcaatttacacatgattataatcatttccagtgcacacatttcatcaccaggtggatcctgagctagcccatgtaaatccgggttaacccatattggtaatcatactcaaaagcacttttcaccctacattctactagccaatcaaagacaaagagttgtggcctctaccattgccttggcttctggacaccctcacaagctatcccaaggttcccgctcaactccagggaggctgacatcttcacatccactgggcatataatattgcatgagaccaaagtctccacactctttgcagcctcctccatgaatcccaatggcctgcacttgtacagtttgggtgtttgatagataaagcacgtatgagaagagaaaacaaaataaatcaactttttaaaaaagccagcactgtgctgtcaatgttttttttttcttttcaattctagctcagaaaagcagaaggtaaataatgtcaggtcaatgaatatcagatatattttttgactgtacattacagtgaagtgtaatctttttacacctgcaagtccatcttatttattcttgtaaatgttccctgacaatgtttgtaatatggctgtgttaaaaaatctatacaataaagctgtgaccctg

SEQ ID NO: 227 - DNA, 507 bp, Homo sapiens
tttgtttaaaaatgtgttttaattatattttcatgaattccaggaagaacatcattgcagttaatgttacaaaaaaaaaaaaacaaagagggacatctgaacatgcaataaaaaagtgaattcacagtgaaaataatgcatgtcagtactaaaatagagttgcttggttccctgaaggaaaagggtttcttctaattatctgttcacttggattttattatgagaaaatattctgtgaaagctttggggaagttttcaatttgtgctactattatcattagagtctgatggaagtccctcattctgaaagccgttgttcgcagtctgtaattcaatcagaaaattcaaaagtacaacaggtagtttggcaactcgcttcttgttacatacaaagccattagcaaaaatatgtaacaaaatttatgtaaaacaaacaattttgtccttatgtacaaaagacagccttcttcctcacaccctcacggcctattccaaaaagtgggaagg

SEQ ID NO: 228 - DNA, 2186 bp, Homo sapiens
acacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctagaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttgggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacaaaaaaaaaa

SEQ ID NO: 229 - DNA, 3178 bp, Homo sapiens
ggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacagctggaaccagttcatcaaccgtcagccacacaactgggaacaccactcaacccagtaaccagaccacccttccagcaactttatcgatagcactgcacaaaagcacaaccggtcagaagcctgatcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacgggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaattgctagactaagaattaggtggctacagatggtagaactaaacaataagcaagagacaataataatggcccttaattattaacaaagtgccagagtctaggctaagcactttatctatatctcatttcattctcacaacttataagtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgcaataaaaacttactttgg

SEQ ID NO: 230 - DNA, 461 bp, Homo sapiens
aaaaaataaaaatcatttatttaaacaaaaatatacacacagtgtacaatgaatatggtttacacagaacaataaaacaaaaatgatatctcttaaatgccaacataaaatgatctatttatgcctagaaaaaatttctaggaatacacattattgattcatctaaaatacatatataacataaaaagaaaacaaatgccaacctttcagatgagtaccacaaaaacctaaaagttaaatgttagattaaataaaattataaaatatccacacgagaagtatgtgtatacaaagtattgtatgtatgcagtgaaatgagagtgcccatacagttatatgcaaacttttgaaagtttcatagttgtttaacaaaatatttttaatgttgatagtgacataaaaacatcacaagaattatctagataatatagcaatattgccaaaatttgagtcaatgttac

SEQ ID NO: 231 - DNA, 6927 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttatttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 232 - DNA, 588 bp, Homo sapiens
  modified_base (391)..(391): a, c, g, t, unknown, or other
  modified_base (405)..(405): a, c, g, t, unknown, or other
  modified_base (425)..(425): a, c, g, t, unknown, or other
  modified_base (500)..(500): a, c, g, t, unknown, or other
  modified_base (516)..(516): a, c, g, t, unknown, or other
  modified_base (527)..(527): a, c, g, t, unknown, or other
  modified_base (547)..(547): a, c, g, t, unknown, or other
  modified_base (554)..(554): a, c, g, t, unknown, or other
  modified_base (561)..(561): a, c, g, t, unknown, or other
  modified_base (572)..(572): a, c, g, t, unknown, or other
gcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagttgaaagcaggaaagaaaaagggacaagaaganaggaaagaaaggcnaaaagaaagagaagaaggcnaagaagggttaagattctgacagctgacaggaccatcgagtctcctgtattaagggactggttggaagaagattnctgtccaggctcttgnaagtcaccccncctgatttcctttggtgagntccgctncctgggncttctctttcnccagtgtcccttgacc

SEQ ID NO: 233 - DNA, 3434 bp, Homo sapiens
cggactgcttccggccagaggtcccgggcggaggaggaagctgtggctgccggcggtgggacgccccggccgctcagcccccgggcactgctgtggggcgttcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttcgtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaaattaataagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaatcaaaaaaaaaaaaaaaaaaag

SEQ ID NO: 234 - DNA, 2229 bp, Homo sapiens
ccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaagggtttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagccaggagttttaagtccagcttggccaagatggtgaaatcccatctctacaaaaaatgcagaacttaatctggacacactgttacacgtgcctgtagtcccagctactctatagcctgaggtgggagaatcacttaagcctggaaggtggaagttgcagtgagtcgagattgcactgctgcattccagccagggtgacagagtgagaccatgtttcaaacaagaaacatttcagagggcaagtaaacagatttgattgtgaggcttctaataaagtagttattagtagtg

SEQ ID NO: 235 - DNA, 473 bp, Homo sapiens
tttttttttttttttttcgatattcagcattcattcaacaaacatttattaggctcctactgtgcgtcgcgctggaaaggcaagcagaagctagattcccaatcgatcccgggaggctggacgatccagacacaaacaccgttcatgcgtctattcgaaaaggccctcttggaattttgtgcacagcatttccttggggtgtcgatggatcggggtctgcaaacattagcaccttttccggtggccgctgtcttctcagacctcagacaccggcgcctccccgtgaactcccgcaggcgtccctagcccagggcttggcgggcgctgccggttgtacctggcctaagccacgctgggccgccagcccggggcgacaccttcttcggacggcggggatttgcggctcgggtgaccggaggtgccctcccgcgggtttcggagcagctccgcgggctctcgctcccctcgtgccg

SEQ ID NO: 236 - DNA, 520 bp, Homo sapiens
ttttttttttgaaagaaatcttttactttttactggagaggaaaaagtaaacagaagtgggtgacaaggtacatataaaatgccattctacggtagctgcagtggccaaaaggcactggggagagctgagtaagaaaaagaaatggcagtctcaacaatgagctggcagtggcagcaagaaacaaagagacaactttgagtgtgggatgacaaaagcagcacacaggtcccacccatctgaatacatcctaggcataaacctgtatataactgtaattaaactgtctctagataacaaagttttaaagaaatcaccctatattttttaagaaggagaaagtcttctacctggggaagttttactcttcagaatgaaaaccttatggaatggggaagtcaaccctcactatgtacgtcaaccctatttctgagataaaagatgaagcagtctgatgggtctcaaatccaatcttgtatgaataaaacaagcatcaggaaacatggatgtcatcttctaaga

SEQ ID NO: 237 - DNA, 2187 bp, Homo sapiens
cgcccgggcaggtgagaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 238 - DNA, 393 bp, Homo sapiens
atgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtga

SEQ ID NO: 239 - DNA, 2681 bp, Homo sapiens
cggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgctttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 240 - DNA, 1224 bp, Homo sapiens
gggcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcac

SEQ ID NO: 241 - DNA, 459 bp, Homo sapiens
tttaacagaaatttacttttattttctgaaaaacttaaacagataaatgacaaaacatgttcattaacagtcaacaataaggcaaggaaggaattcacactattcctcagagcagctccgcaaggcttatcaagtaagcttctgatatagtttatactgtagttgaagctggtttcagaaaagcccatgttttctttagtcagcatgcggggtaagaaaactccgtgaactctctggcaaagtctctttctggcctttcgtcttcctaccatttttggtcatggttccacccaaataaaatggagggattcagatttatcattacatgtaatctttcatctaaacactgtctgcaaatgcctaagtcccaccacgccctacaagctcactcacatacacagcatgtcatgctcacataacaggaaacatgccaaagatagacacccaaaattgtaaaaa

SEQ ID NO: 242 - DNA, 1522 bp, Homo sapiens
ggcacgaggctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatattagccgggcgtggggcagtcgcgtgtcatcccagagactcgggaggctgccgcaggagaatcacttaaacccagcaagcaaaggttgcagtgaaaagacatggcgcttttgcattctagcctgggcgacaaaggcgaggcttcgtctcaaaaaaaattgatcaggagatactcctgttctgtgttggcaagatcctgtaatcctagcactttgggaggtcgatgcatgaggctttcttcagctcaggagttaacagatttgcctgggcaacatagaactcgtctctgcaaaaaaatgaagctaaccaggtgtgacggcttgcgtctgtactatcatttactcggtaggctgaggtggtaggatagcttaaactctcgggctagagactgcaggaacatgtgaatacgctagtgcaattccagcctgggcaacactggaaagggtaggaagagtagtctttgggtccctaaagatcacctgataacaagtttgacttttctgagcactcttgtggagtttgttgtggagggaataccatgggcattggcaatgtaaagttgatctaaaaaatctcgttttccgccgtgcgcggtggctcacgcctctaatcccatcactttgggaggccgagacgggcggatcacgaggtcaggaggtcgagaccatcctggctaacactgtgaaaccctgtctctactaaaaaaatacaaacaaaattagccgggcgtggtggcactcacctgtagtttcagctactctggaagctgaggctggagagtcacttgaacccgggaggcggaggttgcagtgatcagagatcgcgccactgcactccatcctgggcgaaagagctagattccatctcataaaaaaaaaaaaaaaaaaaaaaaaaaaaaa

SEQ ID NO: 243 - DNA, 772 bp, Homo sapiens
ggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatctttctacctactttggtgatcaaaaaagaagagttaaaacaacacatgtaaatgccttttgatatttcatgggaatgtttaaaaatagaaataaagcattttgttaaaacga

SEQ ID NO: 244 - DNA, 479 bp, Homo sapiens
  modified_base (23)..(23): a, c, g, t, unknown, or other
  modified_base (276)..(276): a, c, g, t, unknown, or other
  modified_base (431)..(431): a, c, g, t, unknown, or other
  modified_base (474)..(474): a, c, g, t, unknown, or other
gtatttgagtattgttttattanccaaaacacaaaaccaaaatgaaaactggcttagaatataaaattctcatttttcaaagtgaaagtttgaagatactagctaaagttgataacttaaatagtggtaaaagtaaataacttagaattatggcagcaatcacaagaagaaacagaaaacagggggactagggattcggtggtagacttttactttaaaatagagctatgcagcagattctccatgacttggcttacatgcagtatgtcctatggnagtaaaattttcaaatacctccatcaccttcagtaactcatattaataaaagtaaaaggccaggtatataaaaccaggaaccccagtatataaaccatattacctccaatttggatcccccaggtaaacccaaaggagttttttaaaaaattatnccccaccataccctttttaaggacaactttttccggctacccnacaaa

SEQ ID NO: 245 - DNA, 1601 bp, Homo sapiens
ctccggccatcgtccccacctccacctgggccgcccgcgaggcagcggacggaggccgggagccatgggtgactggggcttcctggagaagttgctggaccaggtccgagagcactcgaccgtggtgggtaagatctggctgacggtgctcttcatcttccgcatcctcatcctgggcctggccggcgagtcagtgtggggtgacgagcagtcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctggcgcagaaggagggggagctgcgggcactgccggccaaggacccacaggtggagcgggcgctggccggcatagagcttcagatggccaagatctcggtggcagaagatggtcgcctgcgcattccgcgagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccagggtcttcttctacctccccgtggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctgtggcccaccaggcactacggcttcctctccagatgtgctttgcctgagcacagacagtcagcatggaatgctcttggccaagggtactggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatcgcacagacagagcttgtgccggatttggccctgtcaaggggactggtgccttgttttcatcactccttcctagttctactgttcaagcttctgaaataaacaggacttgatcacaaaaaaaaaa

SEQ ID NO: 246 - DNA, 467 bp, Homo sapiens
  modified_base (407)..(407): a, c, g, t, unknown, or other
  modified_base (466)..(466): a, c, g, t, unknown, or other
tttttaaaaaacaaagcatgatatattgaacaatagtaaaattaattttaatcaattggcattttcagaataataaaagggcaaaaagtgaaaaaagagatatttgtgacaaaaactgaccaagcactcatatttaaatattcaaggaatgtttacaattcaataacagatgacccaatgtaaaatggacaataagcacttcaaaataaagaaaatatctaataacaataaacttatgaaaatgttatcaaaattagagaaatggatactaatttaatgtaattttccaagatgaaaaattactacacactctccagaatgtctaaaattaaaaaaaaaaaaataccaagtattggcacgaatttgagcaactggcaatctcacatgctgctgctgtagaatacagnaatctgctacaatctgctgctgtagaatacagcaaactgctacaatcacttgaaattgng

SEQ ID NO: 247 - DNA, 476 bp, Homo sapiens
  modified_base (374)..(374): a, c, g, t, unknown, or other
  modified_base (458)..(458): a, c, g, t, unknown, or other
tttttttttctgaaataagaattgatgagtaagtttattgaagagctataggttaaaaccaacattaggtatatgtaaccaatactctaaatatgggataccttcagaaagcatctttctgtctccctctattcctatatatttggtggatgaatttttcactgtttaggataaaaacaacaggtcatatcaggactcttgaacattctcaggcaatagaatgccccacagtcacttgaaattgtttttggtgcatctaatcccatgtcataatcaaaacttaagacttggtttaaagttaagttgtatcttttccccgactgagaagccatgtgggggtgggaaggtgaggaaggggagcgtcttctccttgntcctggcagcttctgatccttgtagggttgcctgttttcataaggttgagtacttccttggcttcacacaaagggggcatgggncagttcacatggctgggg

SEQ ID NO: 248 - DNA, 255 bp, Homo sapiens
tatttttttttttttttttttttttttttttaaaagcaaaaacagaataatttatttgaatccatctttccttgaaaaaaataaaaataagactttaatagtcatttccttaagtgttcacaagtcttctcaaaaatactactggtgattgaaaaaaaagagaaggcatagttttgtttttgtgacaaccatccttattactttgttgtacaaataacaagatagaaatttggaaataaaattgaaacataaatt

SEQ ID NO: 249 - DNA, 1848 bp, Homo sapiens
ggaaagcgcatgcgcgtcgggcacagcgcgtgcagcctcgtgcagctcttctggtctccggcgcccgcccctcagacgtaatgttgaattaaagaaaatactttatcagaagaagatggccactgcccagttgcagaggactcccatgagtgcactggtatttcccaataagatatcaactgaacaccagtctttggtgttagtgaagaggcttctagcagtttcagtatcctgtatcacgtatttgaggggaatattcccagaatgcgcttatggaacaagatatctagatgatctttgtgtcaaaatactgagagaagataaaaattgcccaggatctacacagttagtgaaatggatgctaggatgttatgatgctttacagaaaaaatatgtatacacaaacccagaagatcctcagacaatttcagaatgttaccaattcaaattcaaatacaccaataatggaccactcatggacttcataagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaagttacacccccagattaccagcctcccggttttaaggatggtgattgtgaaggagttatatttgaaggggaacctatgtatttaaatgtgggagaagtctcaacaccttttcacatcttcaaagtaaaagtgaccactgagagagaacgaatggaaaatattgactcaactatactatcaccaaaacaaataaaaacaccatttcaaaaaatcctgagggacaaagatgtagaagatgaacaggagcattatacaagtgatgatttggacattgaaactaaaatggaagaacaggaaaaaaaccctgcatcttctgaacttgaagaaccaagtttagtttgtgaggaagatgaaattatgaggtctaaagaaagtccagatctttctatttctcattctcaggttgagcagttagtcaataaaacatctgaacttgatatgtctgaaagcaaaacaagaagtggaaaagtctttcagaataaaatggcaaatggaaatcaaccagtaaaatcttccaaagaaaatcggaagagaagtcaacatgaatctgggagaatagtcctccatcactttgattcttctagtcaagagtcagtgccaaaaaggagaaagtttagtgaaccaaaggaacatatataaaaattatttttgttctgcaggcttgcagagttcttctcaccatttaaactgaaggaccctatattatatttccctaactctgaagatgtatatgtagtttaaagcagtttgtacactaaaactaagtttttggctgactgtcatattgtggtccttaatcttgagataaatccaatagaacttttgaataaaagcaaaagtacaaatgtcataattgattcggtaataagtaaaatttcaaaattgattttgttcattacctacttaatatttcctttaaatatatactaactgttaaggccctctaatgccatttttctaaacagtaatgtttactttggtattaaaatttggtatggattcactttttacttatgttaaaattataccatttaactggctcttttgtcattgtgctgttattaaaacaatgttcttcaatattttgacataatgtattaacattttaatatataatgtacaatttaaaaaaaaaaaaaaaaaaaaaaaaaaaaaaaaggggcggccgctctagaggatccaagcttacgtacaaaaaaaaaaaaagg

SEQ ID NO: 250 - DNA, 565 bp, Homo sapiens
ataacagagatacaggtttttatttttccatcatgcatgcaaacttacaactatttatactgtttaagaacacagaaataattgcgttattaacagggtgtcaaattaccaagtagaacaaccagttactaattattttggggaggttattttcacagaacacagcaacaatttccaaattattcttccaaaaccagagttatgagaccagtacaagctgataacaatgctaatggtcacacaagtttccatgttacacagaaaaaaagattgacattctggtgaagggtctcaagtaccttaccatatcagaatttttgaaagagttttacaacagaacagtctctctcttgttttgtagatgcaagggaaaggaagcatccctctcatttctttttgagactccttgttaattcttaaaacacatttctaaggcccatctctggaacttcattagttaacattaaaagcaaaaagcagacctgatgtgattatgatagtgcaccccatcactatcaccatcaaaagagactaccaatctcccaaagtagtcacggttgcattg

SEQ ID NO: 251 - DNA, 1364 bp, Homo sapiens
aggggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaagggcctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccggggcccccaccggaagatgtgtacagctggtctttactccatcggcaggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaa

SEQ ID NO: 252 - DNA, 444 bp, Homo sapiens
  modified_base (323)..(323): a, c, g, t, unknown, or other
  modified_base (347)..(347): a, c, g, t, unknown, or other
  modified_base (407)..(407): a, c, g, t, unknown, or other
  modified_base (425)..(425): a, c, g, t, unknown, or other
  modified_base (436)..(436): a, c, g, t, unknown, or other
tttttttttttgcttttatttactttttattgtcatcaagcagttttctaggaattttcagcaaaataccaattcagctataagtctaatatgaaacacaggaactgtgaatataagcttttggtgcttgctatggaaaaatcaaatcaatagctttaatgtcttcttacaatctcattttgtttcactatagctctgttttagttagatctgcacatctgttttgctccaggtagttaattttgccagttcagtttctctgtagatttttgccataggtaggaaaagggattttaaatattaataggccccttaaaatattncattaccattttacttaaatgcancgataggataatgtacatgctttcttttttgtggcaaatacccagggcaatctggacttngaaggacagctttagggncaaattgattnggcaaagg

SEQ ID NO: 253 - DNA, 3332 bp, Homo sapiens
ggtttgccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaaaaaaaaaaaaaaaaa

SEQ ID NO: 254 - DNA, 515 bp, Homo sapiens
  modified_base (236)..(236): a, c, g, t, unknown, or other
gaagacacgaatggaagaatttatattttaaatgaaaatcaagaagttgtccctctgaactgtgaatctctgaaagttggaacttttgataaaggccgaggctgccttaagtaaaaactagagaaagaaaatgtaaagatcataacaccgtagccgttccagttcattgtagaatagaattggtgtgattcctcctcaggaaatttaaactattttgattttctgaatttccgcanacacaactcagaaacagggttgagactaggttgctgccaagctgaaagactgagctgggaaccaatcagcgcgcagcgtgtctgtgtgtgacacacacgtaatcacagacacactcgcagcctgactttttttttttttaactgttagatatccaaacctacaatcatgtccgaaactgtacatgccgtgactcctggtctatctcccaagtcaaagactgaagtaaagaaaaaggttgcaagtccgaagttgcagtgaagtgcaagatgtccaggccc

SEQ ID NO: 255 - DNA, 469 bp, Homo sapiens
  modified_base (98)..(98): a, c, g, t, unknown, or other
  modified_base (171)..(171): a, c, g, t, unknown, or other
  modified_base (269)..(269): a, c, g, t, unknown, or other
  modified_base (369)..(369): a, c, g, t, unknown, or other
  modified_base (374)..(374): a, c, g, t, unknown, or other
tgatggtttacatgttttatttttacctggcaaaaggtagcgtagaaataagggatttaggttttgactaggatcagatgaaactgggcagccttcantaattcacttcacaaacatgcaaatccaacaaaagttcctggaaattcagtcttcaaggagcttattgtctantggaagacaaacagttaaaatcccatatggtaaattctataaaagtgggaggcaaaggctgctgaaggagtgtggaaaggaaacacacaacacacaancccaaataagagaagcagcttcccagaaggtcataattataatgtaattatccactgaatctcatcctaaaggaaaaagggtctgttgggcaaaacaaancttgntgatggggaactatattcttagctaaagaagcactactatacattcagagaatcaagaaaaagcataatagatctaagaaattacaagtatttca

SEQ ID NO: 256 - DNA, 4612 bp, Homo sapiens
ggcgctgggagcgctgtagcagctgagaaggggctgaggcaccgccgcttcgctgacagccggccaccaggtttctgtctcccagtataatcatatccagccccatggctcttactggggcctctgaaatgtttatcaccaaatctgtgtctgcagttccaacctcttccctgagcatcaaagctgtatttccaactttcgctggatgcttctatctggaaatacactgtggtgaaatgcttccacctcttgctaaaatgaacactgaggaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgcctttt

SEQ ID NO: 257 - DNA, 1114 bp, Homo sapiens
gctggagtgcagtggcacaatcacagcccactgcagcctgcatctccttgagctcaggccatcctcccacttcagcctcccaagtagctgggaggcttgagcccaggactataagaccagaccagcctgggcaacatagggaaaccctgtctctatatacagtagttcgcctggagccacagctacctgggaggctgagtttgggaggagtggggaatccacgttctccttgtcagcctcagggctcagctggatcagaggggagctcaggtctatgagctgtcccaccaccggtgaaggtttggccacatttttattcatgtctggagtgtttgtcatgaggtcgatcagaggcctgctttcagatcctacagccacgtgtgcttctggggtatcgcagaagtcgatgagaggaaggtcaatgaggggctggcttgcagcatctggagtgaccgcgagtggttccagtttgatatctacaagaagagcctcactaggggctgcatctccacccggcttggcttcctcccgagctacttctgtggcagtacttttggagaacagtagaatcgctttcctctggagaaaagttaagtgcctgaggcacacgggaaggaggagaacccctgtcagggagacacatccaccagcctggcaatctgtctatctgtgtgctctccccttgtaggttcagtactcattgcagagtacttgcggggctcagaggaccgtctccgaacttggacaacccagggagaagccacgacctgggaatcgaacgggggccatcggggaacgcagaacaccgcgtgggaatcatgatgaggtccgcgtatccagaccggtggacacacaggtgggagacccacggaaagcccacggagttaaactgtgctcaaagtgccccctatcccttgtggtgtgcacccccaggagggttccaaccggcggccttcaacccgccaggctgtgaacaacagaaaacgacatgacaccccgagggcccaagattcacagtgttgtagatggcccccgagcataccaccattcaaaggcaacactgctatgagagaaccacgaaaagggcggcaccacggctggagaacaacagcga

SEQ ID NO: 258 - DNA, 504 bp, Homo sapiens
tacttaaagtaaatgtggctttgttagtttctaaagaatgtacttttcttgttttacttttttaaaaagtcttttcatttcaaaaaaaaagttttgcatttgtctcaagagactcaaataggaagatcagttttcaaggcactcacatcaaattgaatggcagtagaaaaactgtcctataaattattattttattttgttctttatagtgccagtattgtgaatgccacgcttagcaatactgacactcaatctcagctgtcccttacagtttaacccacctctgggccaaagagaagaatatgctgcaatttcttgtttagaagccatttaatttaaatgcaaacaaaagctttaaagtgcgggtcaacagaattcaaatgtctaatcttaacagttcaatatttagtaccttccaacctaatgagataggaaaaaaaaaataaaaacctgggaagtagcgctgggcaccttctgatggaactcatcccctgctttttcagt

SEQ ID NO: 259 - DNA, 4068 bp, Homo sapiens
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgctacagtccctggccctgcttcccatcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagtcttttacttttgtatagcttgataggggcaggggcaatgggatgtagtttttacccaggttctatccaaatctatgtgggcatgagttgggttataactggatcctactatcattgtggctttggttcaaaaggaaacactacatttgctcacagatgattcttctgattcttctgaatgctcccgaactactgactttgaagaggtagcctcctgcctgccattaagcaggaatgtcatgttccagttcattacaaaagaaaacaataaaacaatgtgaatttttataataaaaaaaaaaaaaaggaattc

SEQ ID NO: 260 - DNA, 480 bp, Homo sapiens
cttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggcttacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtggtcccagctactcgggaggctgaggcaggaaaatggcgtgaacccgggaggcggagcttgcagtgagccgagattgcgccactgcagtccgcagtccggcctgggcgacagagcgagactccgt

SEQ ID NO: 261 - DNA, 493 bp, Homo sapiens
ttttttttaacagttcttgggaaactttattataaaaatccaacggtatatataaactgcatttctctagcccaagatacttatgtgatactctacactgtagctcctatggcagaaataatatctgagaaacttcattttgaaaatttggacatattaagcattatagtacccgtcaaaatcttgatgttccccaaacttgagtcatctaggtgaggtcattgctgtcttcaaaaaattcagcaatctcctgtttactgttctagtgaacttaagtgaggttttcatttcaaatgctattatttctagaatttaccttaccctggtttattttcaaattcacctgttttttttcccttaatcgcttttgcccattttaaacagatggtttcactgttgctgactctttccctactgtttatatggcttacagtgttctggtgagatctcagtattctaagatggtgaggccatcccttcaggctggctttac

SEQ ID NO: 262 - DNA, 5502 bp, Homo sapiens
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctggtacgcgtgcttagcccggccccggccctggactgccccagcgatccggtctctgcgccgtgagccccattccccgccatcgtgggccagccttgccctctgtcttgtcactaacccaagctaattccaccctctgccccttcctctctgccccaaactcttccccgggaagggggacagacccaccccagcccagggccctcacccacctcggagaggcgtccccaccatcggatccaggcttgctaggggtcctgaaccaggctacttcgaaccaggaaagccagattccagcctgagtgctggcccaattactgctgagtggccctggacaaagttgtttctctccctgggcctcagtttccccatctctagaatgaggatgttggggaaaatcccggatcaggatctagaagtcttgggtccccgtccctacactcctgttgactcatttggagatcctagatggctgcctgctttcctgggcactcatggtgaaatgacaggcaagaagtggggatgatgtttggggaacaagatacttgacccagcacatcccccgcctggtccaataccaggtggggctcttcctgtccactcccagcctcccactgtcccaccgcctcctgcctctctcctctctccccagaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccaggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagta

SEQ ID NO: 263 - DNA, 1518 bp, Homo sapiens
atgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggctcagtctgagcagcagggtgaggcagccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttag

SEQ ID NO: 264 - DNA, 643 bp, Homo sapiens
gagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagctgcaaaccatcttcacctgggggcattgagtggcgcagagccgggtttcatctggaattaactggatggaagggaaaataaagctatctagcggtgaa

SEQ ID NO: 265 - DNA, 605 bp, Homo sapiens
acaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggcttgaggaccccagtggggagtgttctgttcccgcatatcctggccgtaacgattttttattgttatggactacttgaaaccccttcctgagggtattttactagttgggggctccccataattagctttctttaaaagagctggggatttgtttcacccatatctttttttgtcatataaaaaaaaaatattaattttttttttt

SEQ ID NO: 266 - DNA, 2422 bp, Homo sapiens
tttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccaagcgggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcttgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgctgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaacttgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaagggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactagaa

SEQ ID NO: 267 - DNA, 1674 bp, Homo sapiens
aaagcttcccgagagccatggttggtccaggcaggcagtcggagcacctcgtggagcggctgctaacccagggtggggtggggtggggtggaggggtctgcttgtagtactctcagtcctgatgtcacaggcgcggcaaggacatcgcaaggaggagtcggattacagtaaggatgggcagtgcagcaggcagcccgagcgcactctccagccgccggggatcttagccctggaaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattaatgagaaacataatgtattttggtggtacatgccagagtcctgctctcccggcccttgtccgtccaccagcccctcctttgcaaccatcgctggatattaaaccatttcttccctttcctcttgacactgcagctgcagtcaacctcttccccaatttcaatgcgatggacccgattcagaaagctgtaataaaccatacattcggggttcctcttccccaccgaagaaagcaaatcatatcatgcaacatttgccagttgagatttaattctgatagccaggctgcggcccactacaaaggcacgaaacatgccaagaagctcaaagcactggaagccatgaaaaataagcagaaatctgtaactgccaaggacagcgcaaagactaccttcacctccatcactaccaataccatcaataccagctctgacaaaacagacggtactgcagggacaccagcaatatcaacgacgacaactgtggaaatccgcaaaagcagtgttatgacaactgagatcacctctaaagtggaaaaaagcccaacgacagccactggcaatagctcatgtccttctactgagaccgaggaagaaaaggcaaaacggcttctttactgttcgctatgcaaggttgctgtcaactctgcctcgcagctggaggcgcacaacagtggtactaagcacaaaaccatgttagaagcccggaatggaagtggcactatcaaagcctttcctagggcaggagtgaaaggcaaaggacctgttaataaaggaaacacaggcctccaaaataaaacatttcactgtgaaatctgtgatgtgcacgtcaactcggaaacgcaacttaaacagcacattagcagtagaaggcacaaagacagagctgctgggaagcccccgaaacctaaatacagtccttacaacaaactacagaagacagcacatccactgggggtaaaattagtattttcaaaagaaccttcaaagccattggctccacgaattctaccaaaccctctagcagctgcagcagccgcagcagcagtggcagtgagttcccccttcagtcttcgaactgctccagcagcaacactgttccagacttctgcgcttcctccggcactcctgcggccagctcccggacccattcggaccgcccacactcctgtgctgtttgctccttactaaattccaaataggagtaattgtactgcaataatttttcaaaaaacaaaaaacaaaacaaaaaaaaaaaaaaaaaaaaaa

SEQ ID NO: 268 - DNA, 760 bp, Homo sapiens
  modified_base (748)..(748): a, c, g, t, unknown, or other
ggaaagataactgagaataaagctatcatgcagatatttgcagagataaaagtaatgcagatactgagtggagttttgatcaaactatgcttgaaagccactctaccactagttacacaaaccaataatttcccttcgcagtggaagtcagcttgagttttttcaggtgtttttgtgggtttcaccagatacagcaaagaaattaaaattactgttaatggatgtcaaaaccagtcagaagtatcctaagttatataatttgtcaaacaaccatatacatatattttgtattatatttatccttttgttcttcctttggtaggaaaattgtctcattaattcttatacgaaaggacttaaaattagcaaactttttttgcaaacacatggattccattcttggacttgaggacaacttgacgaacaggctggggaggccttgagtggtctggagccagcttgaagcggagcagagttaatgccactgccactttacactcaattatggcaaaatgctgcccaatgcagttccttaatccagctgagaatggtatgaaggcataaggatgtatttttcagattttcccttgagaatctcaagcgttaaagacctgaggggtctcccagaaataggggtttgggtgaagagcccacatattgataacacagtattcctgcccgtacgagcgtccatctggaaaaggaatgggtttgcgagtacacggatattgttacttaccgtgcgtanaagcggaggata

SEQ ID NO: 269 - DNA, 514 bp, Homo sapiens
tttttttggttgaaaagtatttatttttttcaaatgatctttttcaagcaataaataaaaccagacatattgacttctaaaaaacaaaaccaaacaaaaaaaaaatcccctaaactatatacatcctacaggaatacaggcattatcaaatgtagaaatggtatcactctgaaagatggggctatttacacaagttacaagaattgcgttgctgtctttaagaagtctcctccttgaataactcataaactctaagggagagagagtacctggtggggaagcggggttcaaagaggagacatcctccatctttattgatggacaagacagtctcaaggaaaaacatcaatatccaaacaccgtattgagtcccttaacaaggctccacagatcagctggctttcaaaaagcctggaagggtgctccactcaggaactcccaagagaaaccatcttgtccctcagccaggctgggactggcagtgaggccatgctgagccagtggcaaacccgtg

SEQ ID NO: 270 - DNA, 2211 bp, Homo sapiens
ttgggggtttattctcttcccttctaacttgacagggtcttgctctgtcattcaggcaagagtgcagtagtgtgatcacttcttactgccgcctcaagcttccagcctcaactcaagcaatcctcccacctcagccacccaagtggctgggactacagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatcattatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggaggactcacattccactgcttgctgaagatgatgtcgtgggcattgcagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcgtcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtc

SEQ ID NO: 271 - DNA, 878 bp, Homo sapiens
ccctgcatggcgcgggcggcgccgaacggtgctcagcaatcacccggacagggccaggccgttttctcccgctcagtgcattagtcgttggctgtgggccgccgcgggaagttgaggcctaccacggaggaggctgctgaggtggatctcagggtgatccgcaagggctccctcacccttgccgggaccctgggaacccgaaacaaaatcctacgccaccagcccgccgaatgcgccccctcggccgggggtcctgggtcttcagagaagaactcggccgaatgcggtcagaaagcccgcgaaccgcctggacctgcaggccccgccgcttggagctcccgcctttcccgaccgagcccgtgtctgctcgtgtgtctcactgatgtcttaggtctcaaaaaaaaaagaacagaaaaggtttacagtagacagaagagaactggggccgtgggttcgtggtcccagggggaaactgacgtcgcattgaggtcgtcgtccctcagcttgagctcagcggaacataagcttgcagcaggtggaaaccacggaaggtcggggtgtcttggagctctctggacaccgaaggccaggacacagtcccgaggtccgaaccgcctgtgacctgtgccgggcaccgcggggttgggcgttactcaagttgctgcacagaataagtggactcgggaaactacctgagccgcgaaagatggcaaccagaacacagacaggggccgagtgaaccaccgacgcaagaggacgcactatacactggtgagacgcaaatacacgtccacagaacccctttaataacattgtggtccacactatgagtaccggggagatacatagagagaccacacagggaccttgaacgtcgg

SEQ ID NO: 272 - DNA, 4929 bp, Homo sapiens
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgycccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccacaatatgacgaacccgccccctggagttctcccgctgccgccgccccatgtctgccggaagtaggcgtctccctggacgacggcctcgctccattctctccatcacatccagccccaccctccgacccttcccaccagataagcccaggcccaacttgggatatcaaacggaaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggcctgggggctgcgccggcgagtgctgacccggcagacggcggcagcggcgcgctggcggccgagggcagggcgggtgcgcgcgcggcaccccgatcggtgccgcgaccgccggcgggcgccgccgcgcgcagggcggccggcgcgccggggycctggaaggtgcggggttctgacaagctgccgagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatggacgtggagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaa

SEQ ID NO: 273 - DNA, 605 bp, Homo sapiens
  modified_base (229)..(229): a, c, g, t, unknown, or other
tgaaacaaacgccgggtttaatgtagggcacaggcaccccggagaagtcagctccgtgggaaccgtgggctcagagcacccaggtcatggtggggcagggccaggcctcacctggggaggcccagaaagggagggccacactcaaggtccagggcaagtccacgtgcagacggagccctgcagcccacactgctgttgccaggtgtggctgcgcgggacactcctcggngacaagggcagcagtccagagcacaggaaggaaatgtagcttctcagtgctggggtgcaaggctgaggggccgatgggggacaatggccaccaccaggaggcagcccgggctcacagaccatcttttgccagcctgtacacccgcttcaccctggcatagggccccagggagtcctcaaacacaaaatcccagagcaccttcacccaggagtggtgctgcggcaggtggtcgtagtactcgggcgcgatcttccgcaccagcgggaggttgtagccccggatgctggggaagtcgtggtgctcacgtgtagcccacattgaagggatcagttggaggcccatagtaggagtggtctgtggccctgaggaacatgta

SEQ ID NO: 274 - DNA, 1843 bp, Homo sapiens
aagttaaaagtggatgcagaagcgagcacagacggggctaggggtttcagagaaagtaattgagagtgctggcaacagcagctgaaatatagagaagttgtaggattagctttttcgcccaaagcagcttcagcccacgttttattcccatcgagggagggagaatgggtgccgctgagtgggcgggggagtggtccctgaaaggaggtggagtgctacagcccctccccgttggctctcgctgtttgtccgttgttggtttatactaatttgacaacagccgcctgttgagtctcctccagatcgcagctgaaggatctgttgagcgcttcaggaaaggcggtgagatccggtaccgcagcagagcactctcagctctgggtcttgcaggcgcagggctcccccatgccagcagaaagatttcctctggtgaagaggaccgtcgaatctgtcctcctcaagacacctcttgtacagaatttattcgaatgccacggccaaggtcttccttgaaaaatgttaaccgatgtgtgctttttgtcttttgtcatcctttctttaggacaggcgacactaacaggtgaagatctcgggagaccatgactaagaaaagaattgctgtgattgggggaggagtgagcgggctctcttccatcaagtgctgcgtagaagaaggcttggaacctgtctgctttgaaaggactgatgacatcggagggctctggaggttccaggaaaatcctgaagaaggaagggccagtatttacaaatcagtgatcatcaatacttctaaagagatgatgtgcttcagtgactatccaatcccagatcattatcccaacttcatgcataatgcccaggtcctggagtatttcaggatgtatgccaaagaatttgaccttctaaagtatattcgatttaagaccactgtgtgcagtgtgaagaagcagcctgattttgccacttcaggccaatgggaagtggtcactgaatctgaggggaaaaaggagatgaatgtctttgatggagtcatggtttgcactggccatcacaccaatgctcatctacctctggaaagcttccctggaattgagaagttcaaagggcagtacttccacagtcgagactataagaacccagagggattcactggaaagagagtcattataattggcattgggaattctggaggggatctggctgtagagattagccaaacagccaagcaggttttcctcagcaccaggagaggggcttggatcctgaatcgtgtaggggactacggatatcctgctgatgtgttgttctcttctcgacttacacattttatatggaagatctgtggccaatcattagcaaacaaatatttggaaaaaaagataaaccaaaggtttgaccatgaaatgtttggcctgaagcctaaacacaggtatgttcccaggatgggagtgcagggatagtggccaaagcacaagaataaggactcttcacactggctaatagtaaagccacctctacccatacattaagaaaacccacagtggctgggcatggtggctcacgcctgtaatcccagcactctgggaggcggaggcgggtggatcacctgagctcaggagtttgagaccatcctggccaacacggtgaaaccccatctctactaaaaacacaaaattagccaggtgtggtggcacctgtctgtagtcccagctattcaggaggctgaggcaggagaatcacctgagccctggaggcagaggttgcagtgagctgagattgcaccactgcactccagcctgggcaacagactctgtctcaaaaagaaaaaaaaaaaaaaaaaaag

SEQ ID NO: 275 - DNA, 1813 bp, Homo sapiens
attaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataag

SEQ ID NO: 276 - DNA, 536 bp, Homo sapiens
cattttcaacaaaacaatttattttgatatcttgaaccatctgacataattatgtatatacaagatcttttcaatctacctctcctttagtagttacattaagagattaccatgtctcaagagcaaactgctggaatttaaaacacaattttccataagatctggaatgatcttttctaattattaaacgtgtcagcattagtattttctcccatactcagataaagaaaaatgtttgttaaaatttctgtaactttttttgttgttaattgaatgtaaaggtagtttgtttctctaagcacattgattagtaggcctctctctgtaaagtatttttttaattttaaatatttctgatcacactacagatttagaaataaaatgctgaaataatccaactgagccaggattgctcatttctctcccccactctgaggcgctctgcaggaataaagtactgagggaggtacattaaaataaggagactccttgtggctagtagtgactgaatatcctacgtacctaatttactgcag

SEQ ID NO: 277 - DNA, 440 bp, Homo sapiens
aatgggaaatctacaagtaaaaataggaacaataataaaagaaaatgctctataatggatattctactcagcacacaggatcgcatgagactgtctttgcttttatttaacatgaggcgaaatgagtatatgctgtaattctgcacctgttctatgtatcttgcctgcggggagatactctctataaaactatgcactccatagctcctgtgatgaacagcattcaaattctgcctgttatgaggtgtaattcaataagcaccttttgctgagcagctctttgcaggatacgtgaagggctgagctaagaataaaagcccttttggcaatctgatacttcgccttctcttccactcagttctcagtcgatctcaccatcagataccctgccaaaggcatcactctctcaccagtcacttgctcacatatttatgccagta

SEQ ID NO: 278 - DNA, 2640 bp, Homo sapiens
aaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 279 - DNA, 2674 bp, Homo sapiens
gaattcggcacgagccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatctttatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttgaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaaaaaaaaaaaaaaa

SEQ ID NO: 280 - DNA, 4212 bp, Homo sapiens
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatc

SEQ ID NO: 281 - DNA, 1486 bp, Homo sapiens
cctataaaacttctttaagtattgtaattccagtctgccccaactttaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcgtagatcatttagtccaagaacttaaaactaaatagagccataatttactttggagagtcattttaatttgtctttggtaccaaggagaagacggaaccaaaaacaaactctccaagtatattcacacattcaacaaaatttttgcatgccttctatgtcgtaggcatttttagttcctggggatttggacatggctaagtcagagaaggccattgctcaccatgaacactgtataccagaaggagagtggggaggagacaaaaaacaaataagaccacttcagacaatcaaagtatcagttaagagaatgaaaacaggcctgactcagtggctcacgcctgtaatcccagtactttgggaggcggaggttgggggatcacctgaggtcaggagatcgagaccagcctggacaacatggtgaaaacccgtctctactaaaaatacaaaaattaactgggcatggtggcaggcacctgtaatcccagctactggggaagctgaggcaggagaatcgcttgaacctgggaggcggaggttgcagtgagccaagattctgccactgcacttcagcctgggtgacagtgcgagactccatctcaacatcaaaaaaaaaaaaaaaaaagaataaaaacagggtaacataatgcaaagtaactgtgtggaattaaaaattgattattttagaaaatgtgactggcttaggacggggataatatgtgaacagaaatctatctcatgagaaagtgctactgttgtcaaaattaccttatctgagtgaatggtattttttttatcttttccacacatgcgtgggaaaggtatgatttctgcatgtaattgcagtttaacccttatttctaggttgatcataggtcccagtttacccaggaaaattccagtttatacctgttgtacctgtgtaattattggtagcactccctttcactcttacaatgtcttggtttggatgatatatggtgaagtttttgttgaaactaaattatgaagtctgatatatttggataaaaataaagaattgcttttcttcaaaaaaaaaaaaaaaaaa

SEQ ID NO: 282 - DNA, 509 bp, Homo sapiens
ttttttttgggatctgtgatgtcatcatgacaggccttgcagtaaaaaaatgcccttttaacttctttggcatcacttgcgatgaaaaatcctaaagtaccttcttggatcttaagatggtttccaggattaattaatatacggctctctcggttggcagacttgtactcaatggctatcattaggagcttgagcttcacaaaacacagctcacaaacagtagggaaggacagacccacgaaggcactggagagatattctgtgtacatttcatttgagactccttccaagtagtatttctgccatgtgtcttcctcaatctttatgaatgacctcatggagaagaggttggcaagcatggtggagaggccttgagccaggcagctctgggctatgaagcccaacttcaactctgcgaggcagattgcgtcatcaccttctttccaattccagctcgggatgtttagcagatgggccttgttgtgatactgcagcatttgagtgatgat

SEQ ID NO: 283 - DNA, 491 bp, Homo sapiens
gctgcaaagagcacctttattcacagcaaaaggacgtcaccatagcaacaacacttcaattccctgagaacttttcccttatcattcgctttcctagctatgtctttgcaaagagaaaaacaacaagaaacacagcccacgggacaggtgagccatgctgggcccagcggggaggtggcagctacacaggaggagggcagggatgggaggttccagatgctggaacgcataaatacacagagtgccagacagtcccacttcagctttaaaaacaaagatgaccccgagtttggcttctgttttttctgatccacagaaaagataagataaaataagaccctccccaacccccaccctcccaagcaaaaaacaagaacaccctactttttacccatcccctttcaaaaaaaacagcacagtaaaaaaatactgtcacaatatttacagacacgcccactgtgggcgacttgctctctactttggagaggaga

SEQ ID NO: 284 - DNA, 1816 bp, Homo sapiens
ccggcgtccgccccgctgccccctcccccgggggccatgggggcgcccccgggctaccggccctcagcttgggtgcatctcctccaccaactgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtggggacatgagtccccctgctgcccctgccacatcccagtgggctctgaccccctgatctcaactcgtggcactaacttggaaaagggttgatttaaaataaaagggaagactattttacaagc

SEQ ID NO: 285 - DNA, 573 bp, Homo sapiens
tagtcgcctgaggattttttattgtgttttccacatagataaaaaaataaggctttttgatgaaaagaatccattacaaagtcaaaaatccattacaattataattgaatcagtaacaaaatttagctttaaatgagtcaagtattctgcatttgaaatttaatatcacaaacattcaagattagtgaattttggtaagaaaaaaatactagaagaaaggaaaaggacaccttttcaacagatagtaatttataaaaatttttttaaaagtgctttgggaaaacacacagtatcattacttaagaaaagtcatttaaggaagacttaagtgcttcaagtggagtgtattacagactaaaaaatgttttaaaatttgccaagaaatttaagtgttaaaaatactcttctccttattcagtttcatgtttaaggaaacatttgacagacaagtaaaccaaacgcaaaaaaaagttcacctgcattttaaactaataaattctggatctgtaaaagctcttggtttgtacacagaggccaatgctgacatttattgatctatttttatgtagttaa

SEQ ID NO: 286 - DNA, 2599 bp, Homo sapiens
aaatccgagcctcgcgtgggctcctggcccccgacggacaccaccaggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaagtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatattatcatgtctatttttgatgactcatcaattttgtctattaaagatatttctttaaattaaaaaaaaaaaaaaaaa

SEQ ID NO: 287 - DNA, 618 bp, Homo sapiens
  modified_base (518)..(518): a, c, g, t, unknown, or other
  modified_base (568)..(568): a, c, g, t, unknown, or other
aataactgttcagctacaaaattttattggtatctttttatgttccctctagaggatgtaatgcacaaaagcattgccacggaacatataaaattacaaatgaaatttattgtaaaaagtagaatgtcttctagactggtgtcagtatttatgtcattcataaaccaaaactgctgtataatatattcattgtcagcaagttcatgtgtgtaaattgccatccaatgttattgactgatataagacagatattgaaaagacaatttaaatttactcttccaaacataaactgttccacaaaagcactgtaaaaactccttcaagattttgggttgtgcttgacatttatggttaactacataatttggtcgtgtcataatccattgtgtttggcaatttggcattaaacgcctgcagagcagattggatcctcaccacctcactagtagacagcttgagtctatgacgaagcaagcaagagaaaagatctagacgacgctgaccaggtggggagagtntatttacacggtctctgatctctagtagttgcaaaagtgctgaatcctgngatccctgagtataggggtagtccagctgcaaaatcaggtcccgaattgc

SEQ ID NO: 288 - DNA, 547 bp, Homo sapiens
tttttttttttttgataggctcagcagcatttattttctagttttaagaaaatttgattattcttgtatgaggtctaaagtgtgtatctatcagtccaatcaagcttttaaattttcggaaatactaaatttctaaatcataaagcgtcatttaaaaataattaattgtttcagtccaaaaatagcgtgggtcaaactggaattttcaaagtgacgtatctgtggatgatatgcttatggtaccaaaaagactctcaaaaaccaatactcccacgggcaagggaatagccaagtttgttgcggtttccaatgaatgacatcagccctgtgtaggtctcaatcaaaatgggttcagttaacaccatcagtttctttcctcttccagatccagttgaattcttgtgggcattctggatagctggaacaagcttagacatgaacccagacaacttgcaaatttcaaggaatttctcactggtgtatttcataggatgctcagtgaaagtagcataaggaacttcagtggaccatgggttccagcgggaca

SEQ ID NO: 289 - DNA, 543 bp, Homo sapiens
  modified_base (460)..(460): a, c, g, t, unknown, or other
  modified_base (475)..(475): a, c, g, t, unknown, or other
  modified_base (518)..(518): a, c, g, t, unknown, or other
  modified_base (524)..(524): a, c, g, t, unknown, or other
  modified_base (526)..(526): a, c, g, t, unknown, or other
  modified_base (533)..(533): a, c, g, t, unknown, or other
  modified_base (543)..(543): a, c, g, t, unknown, or other
gagacagcgtctcaccttgtcatctaggctggagtgcagtggctccatcatagcctcctgcagccttgatgactgtgctagagccaccctctcactttagcctcctgagtagctgggactacaggtgcttcccactgtgcctggccaattaacaatttcatttttatttttagtagagatgagatctcactatgttgcccaggctggtcctgaactcctgagctcaagagatcctcccaccttggcctcccaaagtactgggattacaaacaagagccactgtgcctgaccaggctctaagattgctaatctggctatagaaggactaatgttggccacctcagagacattcattcattttaagaaacatcatctttcactgaatataatatgacattttttagaaggcacagcatatatgtaccataaagagccatctcaactctgacataaactttgntatcatacagcatgnttattttatgcgaatgaaagaactcttttagatggtttagacnccaatntntcatatnaccccctggn

SEQ ID NO: 290 - DNA, 573 bp, Homo sapiens
  modified_base (419)..(419): a, c, g, t, unknown, or other
  modified_base (433)..(433): a, c, g, t, unknown, or other
  modified_base (512)..(512): a, c, g, t, unknown, or other
  modified_base (520)..(521): a, c, g, t, unknown, or other
  modified_base (531)..(531): a, c, g, t, unknown, or other
  modified_base (558)..(558): a, c, g, t, unknown, or other
  modified_base (560)..(560): a, c, g, t, unknown, or other
  modified_base (573)..(573): a, c, g, t, unknown, or other
aatttatcacgtgcttaaaaatcttcaaaatagcttagtgaggctcatgacagtgctggccccatggaaatgtagtcttttgttgcgtttaaacactgtcacaccatctatgactgtcccattggtctgaagtgtagtggcaaactaagcatcctataagacaagctaaagcttgctttttgccagtcagttgaaagtcttgcatctcttcactgatgcactttctttaggtattgatagtcagaagcacaaagcatttattatgcattcaatcatgtagctaaacaaaaaactgaagtctcctgaagccatttaaaccagccgttccaaaatctcctgcgaccactttgttagtaccgcaaaaactttcccactataaatgaaggaataaatggtagtgctgctctccagaatcctanggcactggttccgnattttggaccattggatttaactaataactggggcaaaagcctcaaaaaaccctgaaataaatttccagctttactggnaccagccnnaagtaaaaancttaatttgcctggtaactggatggcngnaaaatttaaattn

SEQ ID NO: 291 - DNA, 3248 bp, Homo sapiens
ctagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccctcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccgacccctactcctttttctaataagctgtatctgtaatcacagcattcctacagttgttacagtgtgttttttaaatgaaagtaaacatggttacatttgaatctcttaaataatcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgcgtcatatttttgctgttgtttgtattttttgtggagatggggtttcaccatgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcgaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttc

SEQ ID NO: 292 - DNA, 5322 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggagcaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcatgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttttaatgtcatttgtttttgtttggctgtttgtttattttttaacttttatttcgtctcagtttttggtcacaggccaaataatacagcgctctctctgcttctctcttgcatagatacaatcaagacaatagtgcaccgttccttaaaaacagcatctgaggaatcccccttttgttcttaaactttcagatgtgtcctttgataaccaaattctgtcactcaagacacagacacccacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccac

SEQ ID NO: 293 - DNA, 469 bp, Homo sapiens
gctttcggtgaattaaaatgtatttggtgccagtggtgctgaacatagaataaaaaacagaaaaagggcccagacagggacatccaggctggaggttggagtggagcacagtcagatgtattcacttttctagcatgggtttcaaagtgcgtaaggggagaaaacgcatcatggattgtgctgtgcatcctggacaccgtgcgaggtgctcatagctgtgatcttgtctcccacaactctcttgggtgacagacgtccactgtccacattttatagacaaggagaaagggaagtcaaatgtctcgtccaagtctacacagctaaaaaggggcagaactagggtgacgctcaggcctcatttagagatcgggggttggcgagaagtggggtgggcttctggaggggctgggagagccccacaaggctgcagagggtggtgagcccggagtgggcctggcctggtgtgggc

SEQ ID NO: 294 - DNA, 1588 bp, Homo sapiens
ccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcacgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgat

SEQ ID NO: 295 - DNA, 2412 bp, Homo sapiens
ggcacgaggagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgtgaccccgacaagaagcagaaatggggaagaaactggatctttccaagctcactgatgaagaggcccagcatgtcttggaagttgttcaacgagattttgacctccgaaggaaagaagaggaacggctagaggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaggccgggcgtcttctgagagtcagatctttgagctgaataagcatatttcagctgtggaatgcctgctgacctacctggagaacacagttgtgcctcccttggccaagggtctaggtgctggagtgcgcacggaggccgatgtagaggaggaggccctgaggaggaagctggaggagctgaccagcaacgtcagtgaccaggagacctcgtccgaggaggaggaagccaaggacgaaaaggcagagcccaacagggacaaatcagttgggcctctcccccaggcggacccggaggtgggcacggctgcccatcaaaccaacagacaggaaaaaagcccccaggaccctggggaccccgtccagtacaacaggaccacagatgaggagctgtcagagctggaggacagagtggcagtgacggcctcagaagtccagcaggcagagagcgaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactatacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcaccaaaaaaaaaaaaaaaaaaaaaaaa

SEQ ID NO: 296 - DNA, 876 bp, Homo sapiens
gccgctttttttttttgcctcagccacttccttccttggcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 297 - DNA, 519 bp, Homo sapiens
ttttttttttttttcatgacatggtaaataaatttttatttgatgaaaattactattggtaggagaaatgaatgaggtacttttaggtagttaaatagaaaaacaaatctagaaaatacctggtaacttgtgttggaacacattttccatgatacgtttaatttctagcctctgttccaagttctcattgtgtaagccaaattcctgtaccactttgtcaatggcaatgccaactgcatttatcggggagggtgttggtgggggtaacgtagtgtgcaactcttcctcttgcttctccttaatgtttttcttgtgcctcttttccttgatatgcttatgggcaaatgcaatggattcaattaaaacatcacagagtctgcaggtgtactttgctgtagggtagtttcgtggtcgcctttttagcctgtcaatgcagtctctcttcagtctctcctcagcctgctgtaagcctagcagctccttcgttgaaagtacagactcatcgatcacagggccttc

SEQ ID NO: 298 - DNA, 886 bp, Homo sapiens
tgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccaggtagtggcatggagcaccgtaaccatctgtgcttctgtgatctctatgacagagccacttctccaacctctgaaatgttccctgtctgaaatctggcatgagatggcacaggtgaccacgcagaagccaccagaatcttggcctgcctattcctcctcccaagtctgtgactcttattgtcaagcctcaggacaaacagggctggcgccaatgtggattaacagagaaagcaatctggtgtggctagtgggcagattacacatggcaagccccaggagaaatggaggagctttgtagccacctcccctgtcagccagtattaaacatgttcccttccccttggccggcgtaattcaggaagttcgcccctggttgtgccaccaaaccagggactgtgcccttgggttggctccctggtcctcctggtactcacaagaggtctgtccagggccggttatagatttatcaaggcccgaacaatgggaagcgcaaatgtaaatccttgctgaataataatggagcggcagaccaggacaatgggcctgtatacggctgatcccacctgggaaacaagggaaacgaattgcgggtttagaacaccccgattgaaggcacaactggc

SEQ ID NO: 299 - DNA, 2740 bp, Homo sapiens
gcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgtggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgctcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcagacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttacgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagtcctagaggatccctac

SEQ ID NO: 300 - DNA, 3835 bp, Homo sapiens
catgcgtgactgcccccacactcacacagctctcactccccacatgctccatgcctcctgtccccactgaggagagctcctagaggctcgcccgctccccactgacatgcatccctgcagacaaacgaggcgcccagagagcttccccactgcacttgccagggctgcgggcccagccttgcccctagcttcctctggcgggagctatggctcggaggagaatggggacttctgaacatacctgcccgcaagggggaccggaggtgctcggagtgggcttgtgagggaggtggtgccgcagtccccgctgagcagcctggccccccagatcgtgtacttcactgctacattcccctacgtggtcgtggtcgtgctgcttgtgcttggagtgctgctgcctggcgccctggacagcatcatttactatctcaagcctgactggtcaaagctggggtcccctcaggtgaggtggaggtggggaggctgcagcagggtgttgtgggggagccctgcaggcccctcatgcctgcactctccagccctttctctgtaggtatggatagatgtggggacccagattttcttttcttatgccattggcctgggggccctcacagccctgggcagctacaaccgcttcaacaacaactgctacaagtaagcactgctgccctgccacccgtgccctgtcccgccctgccctgcccagcagcctaacccatccactctggcccctccacccctccaggacgccatcatcctggctgtcatcaacagtgggaccagcttctttgctggcttcgtggtcttctccatcctgggcttcatggctgcagagcagggcatgcacatctccaaggtggcagagtcaggtagggccctacccccagccccgcctccagagcagcaactgccacccagatgcatgatgtacaagaacacgcaatagaaatgctgaaaagtgatgaggattcaaacagaacttctcagattgtgggcctgtgggggcaggtcctgggatttttcaatgttgacagagacaggacctcccagcccctgctgcatgacccagggttgacagcacctcagaggcaggcgtgggcatgggcgtgagtgttgcaggcagggctcagggtgcgcgcagggcacgacatcggctgcaaggtctagagcctgcacctttcccacagggccgggcctggccttcatcgcctacccacaggctgtcacactgatgccagtggccccactctgggctgccctgttcttcttcatgctgttgctgcttggtctcgacaaccagtttgcatgggctctgggacagggagccaggagaggggcggagtgagggctgcgggcaaggaaaggggtggagggtggtgcggggctcggcctgagctagcctggccacagtttgtaggtgtggagggcttcatcaccggcctcctcaacctcctcccggcctcctactacttctgtttccaaagggagatctctgtggccctctgttgtgccctccgctttgtcattgatctctccatggtgactgatgtgagtggggtggggggtctgcctgtgacctctggtggccgtctgccatcctccctgactgggctctgtcccccagggtgggatgtatgtcttccagctgtttgactactactcggccagcggcaccaccctgctctggcaggccttttgggagtgcgtggtggtggtctgggtgtatggtaggtcatggctgagggctgggctggggcatggtgacggggaaggcaggtctccagcttggccctcccgcctcgccttgccacaggagctgaccgcttcacggacgacattgcctgtatgatcgggtaccgaccttgcccctggatgaaatggtgctggtccttcttcaccccgctggtttgcatggtaagggctgggggaggtggggcggggtggggggggcggggcggggtgggggccccattaaggacgggcattctggtctgtagggcatcttcatcttcaacgttgtgtactacaagccgctggtctacaacaacacctacgtgtacccgtggtggggtgaggccatgggctgggccttcgtgctgtcctccatgctgtgcatgccactgcacctcctgggctgcctcctcagggccaagggcaccatggctgaggtaaggctccctcccggcctgccctcccctcccctgctatgaacattcaacccagcctgcttcctagccaaggagtggccctgactagggtggcaggcagcaggagctggagagagaggcagaggaagtcaccgtggggatgagcaggtgactctgggggcttcaacatgtcctctcctgcagtgctggaagcacctgacccagcccatctggggcctccaccacttggagtaccgagctcaggatgcagatgtcaggggcctgaccaccctgaccccagtgtccgagagcagcaaggtcgtcgtggtggagagtgtcatgggacagctcagctcacatcaccagctcacctctggtagccatagcagcccctgcttcatccccaccccacccctccagggggcctgcctttccctgacacttttggggtctgcctgggagaggaggggagaaagcaccatgagtgctcactaaaacaactttttccatttttaataaaacgccaaaaatatcacaacccaccaaaaatagatgcctctccccctccagtcctagcccagctggtcctaggccccgcctagtgccccacccccacccacagtgctgcactcctcctgcccctgccacgcccaccccctgcccacctctccaggttctgctctgtagcacacccttgggtgacccctcaccccagaagcagcagtggcagcttgggaaatgtgaggaagggaaggagggagagacgggagggaggagagagaggagaagggaggcaggggaggggcagcagaaccaagacaaatatttcagctgggctatacccctctccccatccctgttatagaagcttagagagccagccagcagtggaaccttctggttcctgcgccaatcaccaccaatatcaattgtgtgagcttgggtgcgagtgcacgcgtgcgtgagcacgtagagtatatatagatctctatctcttagcaaaggtgaataccagatgtaaatggtgcctctgggcaaaggaggcttgtattttgcacattttataacaacttgagagaatgagatttctgcttgtatatttctaaaaagaggaaggagccccaaacccatcctctcctttaccactccccatttcctgtgagccctaccttacccctctgcccctagcctaggagtgtgaatttatagatctaactttcagaggcaaaacaaaagcttcgagctgttgatgtgcagtctgttgtgtggatgtgtgtgtgtggtcccccagacccagaatggattggaaaagtgcatggtggggcctcggggctgtccccacgctgtccctttgcccacaggtctgtggggcaacaggctgcaatattccatcctgggtgtctgggctgctaacctggcctgctcaggcttcccaccctgtgccctgggctgggcacacccccgggaagggaccccggacacggctcccacatccaggctcaaggcggatgcacttcctgcacctccagtcttctgtgtagcggctttaacccacgtatgtctgtcacgtccagtcccgagacggctgagtgaccccaagaaaggcttccctgacacccggacagaggctggagggctggggctgggtgagggtggtgggcctgcggggacattctactgtgcta

SEQ ID NO: 301 - DNA, 2453 bp, Homo sapiens
tttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatcctttaggctttttcacgagatttcctaagtggtgaaggtgacctttcccgtcgccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccattagacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaagtatatttatattagatcttgtgttgttatcattcagaaaagatttcggtgctttcaagcccaaaagttatat

SEQ ID NO: 302 - DNA, 10215 bp, Homo sapiens
  modified_base (4908)..(4908): a, c, g, t, unknown, or other
  modified_base (5098)..(5098): a, c, g, t, unknown, or other
  modified_base (9196)..(9196): a, c, g, t, unknown, or other
gcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaaaagacgaggaggacaggggcggggggcgggaggcttgccaccttcagcccccccgcgaacgcccaaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcgatgagtataggatcaaaccagtggaagaggtcaaatacatgaaaaatggggcagaagaagagcagaaaatagcagccaggaaccaagaaaacttggaaaaaagtgccagctcaaatgtaagacttaaaactaataaagaggttccgggattagttcatcaacccagagcaaacatgcacatctctgaaagccaacaagaattcttcagaatgctggatgaaaaaattgaaaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttcccttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctaccaagcattagcaaggctgaaagtggtctaagaggtgaggggacatcctatgactttttaggaaggcctgaaaccaccttgttacctttcattttgttagcaaataaaccatcctattttgtaactctcccccttcaaaatgctacatgagccttgccacttcctttttctcttacttccagcacactagacatagcaaaagtgtttgcctactcaaaaacataatacttttatgctgatgatggtatttggagatgtgaaagccaaaagcccctggcagtggtggggaatgttgactgagtgttcagcagagtttatttttccatactatatgaagagaatgatctcttctcaaagacagaagtgatatttttaacaaatattgtcacaagtaaatagcaatcaaaaggagaaaataacttttgtatttttttaatgtgtttgatagctttgacgagggttctctttgttactttcaggggagggcatcctattaaatgccacgccagcagtccgggtctgggtttgtcccacaaaatcacaggagcactgtatgttcctctcttttggagttgtgactttgaagggcctcaatattagccacactgccgcctgcagaaggtggagagttaagatgttctatgtcaatttgctcttgccgaaaagatgagcctcgattttaaaatctatccacatccaactgatggcaccattgatgtgcaaataatgagattccctatctccttttagacctgggacggcaaaagggaagggaaggaaacttagcagagtgctattgactatagattcacatattagcaacaaaatcccgtaattcttttggccaacagcagctattttggggagcagctgtggctgttacataaatagagatgcagccaaaattttaggccttttatcctgcttctagcagaaaaatgcagggagagtcaagtagtctagggtttcaggttgcctcccctcatatggtttttggccaagtgactaaaacagttttccacaactgtaaacaaactggtaagccccacctcaaacttgttcactggggactttgcttaccgttctgtgggtgaccttttccgggatttcttgttcttatcaagcaagaattaagcacatgctaaacgtcttccatttgacttctctactcggtgtctcagacagtgtcttcccagaaaaccaccaccctctacccaaagatgaaacatgctcatgtcatttttctcatggtcacatttaacagttttgacatgttatacttgcgcatagatccaagcgtttcttgggaacctgacttttgagtgtttaataaagccggaagtggtgttgccctgaaccagcagattttcacctgggttctggctccggtgtttaacactggatacatctttgatgtgcgaaagtgagttcatcttcagacacatttggtacatccagaaatagatccaagaaatggggtggttgagtgggtccgcacgaaatgcttgattatgtcagcaacacccaacactgtctgttttccatttgttggttttaatcataaaattgtcaagtgattcgtgttgtactttatttttgtgccttctgaacggatctaaaacaaawgtattttgccttttttaccccacgtgtatctgaacattaagcagattggctcagacaccatgaaaaggatactccaatgtacgtgctggtgcactctgctagttgttatctctgtagggctcaagaagctggaaggaggaagggagggtaagtggcctggtgagtggaggtagaaaaatgatgagaaatgaactgagagcattaagcagagagggttgataggctggccgtgtccggggtgaaattggaaatccagctgcctagtggccagtgggtggggcaagactgtcaacgagatttacagctggcttacacatgccttatgtcctctgagttgtagagttgtaaaagttcagcagtgtgtgcacagctttcttttggttggcagagattcaggatcatggagtactgctctcataattgaagacgtgtttgttattggcagagaaccttaaaaaaggcctttacctcagcgatgcttcctagccccaggcttgcagagaacacagagtggtgttgtggtctatttagggacaaagaaggtataaagtccagagatgagaaaactgggtcagccctcagaaactgcagcagccacgcacacagaagcctgctggaagacaggtctctctccgtccacagtgcccatcatctgagcctgggctgggatgactcaacttagcaaagacggacccaggaggagtgctggttcttcagtctttgtactggccccatcctctcctcactgtaatgtgaggaagcacctctgtgtcagggctcacctgggcatccaaagcggccacgcccacaatccgacagcccccaggagcaggtccagggatgatgcagcccccttcttggtcccatgtgatgtcatcctgctttgttatcttcttataactttatcctgctataactttatcctcttcccagcctcatccctgtttttctgttagggcaagactcttccataagcctgctaaaaaacagagatgatacctcttacaaactttacctcatagcctgtgaagcaggttggcatgtggattacaagtcctgctttgacactgggcaagaatttaagattgttctatctctactagtcatagaaaagaaacattgttaaacatgttgagttttaaaggaagaaatattttcaaattcttaatccaagaaaatactgagttggaatcttagacttcgggactctgacacgttctttatgaaaggcaaaataattggtatctaaagttctctccttcctgcctcccctaaagaaaaaggatattagattgcacactataattttacataagatctgccttccacacttccctgctggaaggcattctcagagctttatgtcttcgtacctctcagagattggactttttcttgtttaaaaccccaaccaaaaaaaataataaggcatgattggtggggagggaatgtgtatttaggggcataataaaaaggtggctcgaagcaggaactttggcctcatggtgtcatgggtggatgcctggactccagtgtgcctgtgaggggctgggttaggcagtcggctgtcacactcacatgtgcctgcaataaaccttttggaatttcatgaacgaggtnctatgaattgccttttgccaatgaatggatgtatttttccaaggggggaatagtatccttgactttggcagtcacctttttgtatgtctctagaraggggtcaaaaaaactatggtaaagatgaggcttatgagtgaatacctctgggacaaaccttaggactcacaagctatgccatgtttttcagganactctgtacctatctggaatccaatcctgggagaagaggaaaaaggagctaatatttgtcctttatactcactctgtgccagatactgtgscaggcatttataattgtttgtgtcaccccatgatatccgttaaattaatctattacccccgtgttctaaataatagatcttaagtgtggaatgcatctatccaacataaatgcccatgttgaaagaaggaaagatgtcattcaagtatttttcaaattctttttattatgactatgcccttcgcaacactgtgaaaacaacccctgggggcatctgccttccagaatctctctctggcttctcaccagcttggtttcctcatggggagtgttttatttggcctcccctatctgakctgcacacacaccagggggaggccactggctaacagtaggacttcagtgccctgaggaaaaggctttgggaatttaggcacacgtttctctccttggaatccttctagcatctggaaaaggaacctggtatttctgcagttagataccagatgcaccagaacaggcttcgagtgctgtgattcttcctggttcccaagtcttgttgttcatcacaaactgtatctttttaaggttaaaagtcttgaccttcatggggtctgggacaatccgatctccaagcatggaggaaaggcaatgcctggaccactgacttgcattgaaatcctttcttgtgggctagggtttgatgtctctttttcatctttggactggggatctgcatcttccaggtccatttaagcactgaaactagatgcaaatctctttcgagaccttacatgttttagatagtcatgtaatgacttggatagacatttaaataacttgttccaaggtcggaagacccaagaactcctcagagttcctcttcttgcttcttgaatcacatcctctaaagatgactcatgtctccatagcaattgttaaaggtgctgcctagacgggacccgctcccacctttacttactttgctcgaaggaaccaaaacaatgtccttgtgtaaaggggctgtcatatccagttttcctttgaaatctggcccccaagatcctgcttctttctaacctggcagctgtcatgtcccttcaagatgatgtgggaaatggcccttacaacttgggaaccacagaaattgctgtatttcgggaagattcacctctaaactgaaggcttcattctgatagtgtctgccctctctaccctgatttcgcccttctttgcttccatttttagcccaaggctttgaatttgattgagtaagacttagaggcagtataaagaacaccataaacttaggcagaggtcccttagggtctctagagttgaaaataattctacagccttagggggacctcttggcattgactctaaagggagagaatagcccctgtgtcctggcatttcagtctagaccttcaaggactgttctctcttgacaggcaagcaagcaaagaaagttttgcaatagatttcaagccagtttttccattcaaaccaagatgcaaattcataaaattactcttttcctggaatagatccaggcagctgccttattagaactttagattcggatctattttcttaacacacatacacatacacgcgcatacatacatatacagagagatacgtggagaaaggaaatttactctatcattgcaatacttcaagaaagagctgtattttgcctttctgtaatctccaagatagtgtctaggaaagtaatagtataactatagggataccgaaacaggaaaaaccagccatcactcttgagaaagtttgagttcgactcacatgggagaatcgaggtctgctactcgtcttgctttgtgccccatctgtgcctggatgccctactacayctgcttgactcgtctgggctgctagccggggtgttgtggctgacatcctttcctggccttacacacataatagacacatccctaacggcgtgtgcctggtccagccacatacagccaccacatgtgtcacacactgtccccctcatccatgtggacttgactggcatttcagcagctccactgggatgctctaaccccagtgtgtggagttggggtcccttcatctaggttgacccaggtatagcatttttagcattgcctttccagtcttgatgattcattcattgaactcatttatttctggagcccctggtacactccaggcactgcgctaattgccagcaaagcacaactgaactaaatccaccttcaaggaacctagccataacgagggaggcagcatggaagtaccctacaggggaaagtcctgagtgctgtgggagcatctcaccgtggcagccagcccagttttggcaatcaggggcttcctgaaagaggtgacatcaaagcccggatgtgtcagaggactgagggagagtgttactaaaggactttcaggctgagaggatagcacaggactcagcccaaaggagggccagtgtggactgtccagggccagcctgcagtacagaggctggagcttggacttgtagagggagagagaagagcaagggacgtggacggggcagtgagccaggctagccacagagggttcccggggctttgctggggattcagggagcataaataagagctttaggtggtgctgtgtcctctgcagcccactgctgaggtcctccagacagrtaaggtgtggtcacaatcagggccggggtttccctgctcactgcggcagtgcaggggtgcttgctgagatgaytcatcccagggtgtcctctgtcccttacccagccccaactcctcttcctctgccaaaagctatttgaattcaaggactttaacctgggccggatctggtttggagacaaaggggacagctctgggtcagcatgaccttctttagagccactaaggcgaaaaataccgtttgggaccaggctggcctagacccagggatgagaatgcaccctaaaataaatatacgggaagcagcagagggcttccctgtctagtgtgtgatcctaactaaaggcagctctcttgggcagccttcccctggattaggtcacatacacctggtggccaagcctctgctgggtcccaaatacacacccgagtcctgccaaagaaaggagatttttaaaaagcacagacaaattgtatgcaagtggaaaatacccataggcctagacagctgtggagggaagacctcgtgggtacctggaggctgccagagctgggagctctgcaggtatgagtcagggaaggctcagagacaagcagaatctctctatggagacaacttgcagtgccttttaggttttccaaataacctcggagttcagagcattgggtttttttctcccctccccacccccagaaaaataattagaaaaatgtttaggagaaaggaaaagaattagatgcatcagaataccagctataagccaacactgtttccagaaactcaagaaaaagctcaaacagaagacagttcccctgagaggctggaggcgttggtgctgaaggcaattttcctagctaaggggcactgggccttgctgcaccttggggctgaccttttttgcaaaacacccacccctgccctcctggcatactcaacagcaacgccagctttctggacccttggaaagatgttagctcaaacacccactttttccagatcttcctcttgctcttcactgaggaatttgtaattctgaggctagcgatgccgactcggatattccgcagcccaggtgtttagattagaatttgtccagcggtaatcctgatgctggaaaccaacaaacatttggcctcatattcacccatttaaaaactagagcccctggcaggtccccttagggccatgtgttcatggaatataagccaagtttgccytagcgctkgttcatggaatataagccaagtttacctctccccattttctgccctggcccacttcccactcacctccacctcattgccaggaagggatcaaaatgcctccatgccagttgttaaatggctacatatttgcccttcccaagggtatttgcatttntatttaggaacatggccttatattcaaggaaaatctagcatcaagattacgaggcatcacctctcaatcaggtctgggaggtatcttggggcattgctcttctgaacacctgcagaggcttcctcaggtgagtgtgggagcccggaagtggcctccctaaccactctgcctgcacatgaattctccaaagcagtgggcccccatctgtttcaattacacatgcctgtcagcaaaaacttcgtgagatgcactctctctgtgtgtttattaatttatttaaagcatatatccctttacttttgtactactatattaggcacattataaaaagtatacagcatagaaactttaaatgaataagacacaaaatattataaacagaggttctggcattttctctctgaactcctgagggggaccttgggcacctcctggtatgtgcacaccccactttgaacacccttgctttagtgcaaatcagcacgcctaaatrgcatcccaaacccactgtgcgacatttggcctgcagaataggaaagtcctaggscagaatccccaggaacttcaaatctgggagatgaggaaagaaaactcactcacaaacaacataaatgtaaataattcaaaaccctaaaggagagctgtccctagacagtagtggctacaggtgctaagcaaaagtcaggtacactggacagagccatgcgattgattgttcatcttccctctctgggtctccagaaaaggacactggcaatatccccagctctctcctgattggaattctttgaaccctcgaagtgctccagcagtactaccccccacgtagcagtgggcccatgtcgcttgaatattatttttgatttgaccaccaagatgtaatgatgattctattccattttgaaaagggtctgagaaagtgtacaggtctaattatatatacatatttatacatgtgtatttttgtttattgttacattttgacattggactttctattaaataatttttaagagttg

SEQ ID NO: 303 - DNA, 3273 bp, Homo sapiens
gaattcggcacgagcgagtcgcgacgtcgtcggcaagcggccgccttccacgtaacgcgcgccggcgggggagggcgttggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcctcggagtgaggatgccaggtcatctccctctcagagacgtagaggcgaggattccacctccacgggggagttgcagccgatgccaacctcgcctggagtggacctgcagagcactgctgcgcaggacgtgctgttttccagccctccccaaatgcattcttcagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggcagcagcagaagatatagtggcaagtgagcagtctctaggccaaaaacttgtgatctggggaacagatgtaaatgtggcagcatgcaaagaaaactttcagagatttcttcagcgttttattgaccctctggctaaagaagaagaaaatgttggcatagatattactgaacctctatacatgcaacgacttggggagattaatgttattggtgagcaatttttaaatgtgaactgtgaacacatcaaatcatttgacaaaaatttgtacagacaactcatctcttacccacaggaagttattccaacttttgacatggctgtcaatgaaatcttctttgaccgttaccctgactcaatcttagaacatcagattcaagtaagaccattcaacgcattgaagactaagaatatgagaaacctgaatccagaagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatgatcaagcttcaggagtctccggaagacatgcctgcagggcagacaccacacacagttatcctgtttgctcacaatgatctcgttgacaaggtccagcctggggacagagtgaatgttacaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggctgggatcatctgtcagctcaatgcgcgcacctctgtcctggcagcagcaaatcccattgagtctcagtggaatcctaaaaaaacaaccattgaaaacatccagctgcctcatactttattatcaaggtttgatttgatcttcctcatgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcatgcaattctgcacgccacatgggtgtggtcatgcaatcatcagttggccgccatcagtgtaaatagagcttaaagtcatggtttggctgcataaaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagatcgcttaaacccaggcggcagaggttgcagtgagccaagatcgcgccactgcactccagcctcagcaatagagtgagactgtctcaaaaaaaaaa

SEQ ID NO: 304 - DNA, 671 bp, Homo sapiens
ttgaatttaggtgacactatagaagagctatgacgtcgcatgcacgcgtacgtaagcttggatcctctagagcggccgcctactactactaaattcgcggccgcgtcgacttttttttttttttttttaaaaaacaatgaaccatgaatgccattaatgctttttctatttaaattggtagagcctctcaagatagcaagagagcatattgtggtgttgtagaaagaatatggtctttggagtcagccttatttaaaggtccaatctgagtaatttcagaaaagttgatttgacacaattagttaagtgttctcttctacgaaatagtgataatgttgtccacttttctgagttgcgacaattagaggttatatatgtaagctacctggaacagagtcagtgctctattcacctggatgaatggatcaatgacattataaagactctataaatttgcaattccagaaaagccaaatactttcccttttgcattttgcatgtatgtgcatgaatatatggctccaaagacaattatgaaggagagatgccacaaaatatgatgctatgttctagatgcatagtggcacgggattgcaaaatagttccaattgcactaagaataataaagtcgagaaaattgagatcctacagaaatattttatcttatggga

SEQ ID NO: 305 - DNA, 505 bp, Homo sapiens
gcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaaggcccaaaaaaaaaaaaaaaaaaaaaa

SEQ ID NO: 306 - DNA, 4766 bp, Homo sapiens
ttttttttttttttttttaagcaggagaatggcgtgaacccgggaagcggagcttgcagtgagccgagattgcgccactgcagtccgcagtccagcctgggcgacagagcgagactccgtctcaaaaaaaaaaaaaaaagattgcacagactgtttcctctccggtgcaatcccctgtcctttccacgcaaagataaccactagactgggtattctgctataacccccctccttttccttatggcttgcctcatatatgtgtattgctacacagtatattagttttgcatgtctttgaacttcctatgaatggagtcatggaggaaaaatgtcctgcaccttgctgttttcattcccctttatcccgagaggcagctctgcatcctgtggtacttcacagccttgtatgaatagagcgtcttttccttctcttttctgctgttgatggacatttcagttggttccagtgttttgctgttgcatacagttctgctgtaaactttcttgcacacatcaactggcacacatgcacacgaattctttagggtatagttaagacaatttttgagttacaggtatgcgtatctgctattttaccaagaaaagcagattgttgtttttccagctgtatgtaagaattccagtaacttcacatcctagccaacacttgatagaatcagaccttaaaatgcttaccaacattataaacttgaaatgtctgagtgattttaatttgtatttccctggtttccagtcatattgagcatcctttaatgagtttattggctatttgtatttcctctttatgaagggcctatataaatcttttgcttacttttcaatttgattgtctttttctagatttgtaagagttctagatactcatcttaaataatgtgtgttgcaaataccttctggcttgtggcttatcttttcacactttttatgattggttaaagattaatatgttgttaattttaacgattttatcctctctccttaaatgtatcagcctttatactttgagcttttatttgttagaaatctctcttggtcatttaggcagtctcctatacttactgttttctaaaagttttataattttgcttttcatatttaagttcttagtccgtgggtttggtgattgtgtagcataaagaaagagaccagatttacttgtttctgtaatacatcaccaggtgtcccagtgtcatctctggagaagtccagccttttctccactgatttgtgttgccagctatgtcaaagtgaaatttccgtaagagtgtgaatctgtttctaagctgttttgttctgttggtctctctgtctattccagtgcttcactgtctagctttaggataattgttgatagttgacttagcaggtcccctacctttttcttgtttttcaagagtgtcttgattagtggcactttattcttctttaaaatttttaaaatcagcttgtcttgttccacaaactaaccagctgggattacaggtatgagccaccgcacctggcccttgggcataaattgtaacataagtgtatgttcttcgacacatttaagagtggagtgatggtgtcataaaattaaataatgggatgttctaagtcccttaagctggacctttccaatctgtgcatcaaagctaattctgcattaaagtgcaaggacggctcacaaaccccatagttgcctgatatagattggcaggtgcattctcttggtttcgtttttattcctgctgaaatgtttaatgatcttgtgtggcgtcattctgttgccgattgtgtaagagagaagctggacctgggtggagacaggcttcttaggtggcctcagtgggctgttgggcatttatggttctgctggttgcagctgagatcttcagacagaatactcttctccttgaccagcgcttatctttcagattgtgaactaggcccagacaccattaccattcaccatctctaacattctcttattctttgactacataaggcactgtcgttctaggggaaacatgatagaggaaggaagttggttgcagaaaccattctttgaaagacttttttttttttttaacttagtcaattaaaatagtcctttaaggtgaacttagttctgagtttctggtccttttcccagatggaaaaggattttcaagaaaaaatcctgtcacttactgagcatgtgtgccggctcctttttggcacttccatcctcaccacaaccctataaaggagggagctcgtggcgaggcagcccaggtttctagataaggagagtctcgaggaggttccttaaccttcctgtggtggtttttctccattttttaaaatgaagaaacagaggccaagagaggttagggaatttgctcaaggtcgtgcagccagtggcagctgttctcactcggagttctgagagaggtaagcctcagaagccgggcatccattgtgtgtaacgtagtaacgtcttgcctgtgcatctagaaaggtacctgttatgttccgttcataggagaattgagaaaatattaatagtcacttcattttaagaactccagttgaaaaaggctagacagtcaatgtttgttcattgtttttctccattcttccccagcatgcgcgctctctcatgcacacgcacgcatgcgcacgtggctgagccaaagcctaagctgcgaattgagtttcgttaattcatgtggaggcagctgagagtgccacctggtcctgaagaaattgggatacttgtgggcacaaaggtggacctgagatcactggagccaagctggtggaagtgttgaccactgccgttggcagagagctgtcattactggtgcttcaggccacagctcagcaggctgtccttgttctgttttgttaagagcctagcagcatggctagcttgcaggcataatcccagagcctcttgctatctgcctgcaggaagtctctatgtgctccagcacactgaaggaatttggtgctcactttctcctgcttttgagctttggtcctgtgttattactaatccttagaggaagattttgactgtaaccactttcctgagtgctcttaaggcaggtccagaggattctcacagcgtgaaatgagaaaacgctcagcctcagaaaaatggaagttattcttttagtgccaaagtgtcattggaccacagtgcagcttggttaattcaggttaagacttagcccctggaacagtgtcaagccaaggcctgtgtggtttcatcatagatttgtaaaacaaaaaacacgtgtgttctggtaaattccaagcgcacattagtgcatacgtgtatgtgcaggagcactccctgtaagactcttgttctcatttcacactggcgcgtccccggggctggggaaatcattttcatttttgagagtaaccttaactaattaaatggatcaagggactctttgtgttttgttttcattttgttttgttttttactttaatgtacagataaattaagggaaataataattaccttgaataattttgattctcgtaactaattttccacctatgtgtgtttagctcaattttgaaatggttcactgaaagatttccaaatttcttatcactgaaactgagttatttcacttttatgactgttagtgactcctctgttttatgtatttctggtgcagtataattcttctatgtctgtgtgtctgtgatagatctcagttcaagttagcgtttcccgagcacccatcttgtgtcaggcactctgctaatgattgcgcaggttacaaggtttagagtggccacatcccctgttcacttgcagtttagagtccagtcggaggaaagggaggaggggaatcatgttatagacataacttgatatcctgcaggactcagtgatgtatgagcctcaaaaaggtcacagctgagtgagagagttggtaatcatggaaacaggcgcatcggaaactcgcttcctatgggtcagtaaagtgtgtatgaggtggtgtggatgacagcacatagagctggaggggtgggccagcagcaaccaggagaaggcgttccaggtgtctgcacccaaggagatcctggggtcagaggcaggacatgtgggaaaaaccattggtcccttttacccagggaaggactcaagaagccgaacgtgataggagatggaggctcccaagccctggcagacgttacagcagcgctgagcactttcaggaccaggactccaaggtccagctctggaacgcccctctctgccctgactttggttccttcatcagcagaggggctcctgggctatgggctcaagtctgaagtcaccttaaagagaaatctctacctttctgttctccttcattgctgaggattttgacttgtgttgaaaagtttctgaagctttctgcagctggaaaatcaagcttttaaaaaagctcttgatgggccaggcttggtggctcacgcctgtaatcccagcactttaggaggccaaggcaggtggatcatgagatcaggagtttgagactagcctggtcagcatggtgaaacgccatccctactaaggatacaaaaattggccgggtgcggtggcgcgtgcctgtggttccagctgctcgggaggttgagggagaagaatcacttaaacccaggaggtggaggttgcagtgagctgagaccatgccactgcactccagcctgggcaacagagcaaggctctgttttgtttcgtttaaaaaaaaaaaaaaaaaaaa

SEQ ID NO: 307 - DNA, 587 bp, Homo sapiens
ttgtggtttacaggttatatttattattttctatagtatctaaaaagtaacatatattgttaagactttgttaaaaataactctttacacagctttcggaaggtaactggcaaacaaggtttacaagtaaaagataaacttttcaaactaaaatcagtttgttgtctttacgcaatttacagaagcaagttatgattcaatttaagtatctgaagcagtttccacaataaagcattcccaagaaatagaaaacggagcttagataaagcaccagctgtcacattgtcaccaagttaacactggttcctcactggtctccataacatgatggagagcaggagaagaaagggaaggaacacttagagaggaaaaaaaaaaaaccctgaaatctgaaattacatttacttagggcatcccctaaaggcatcttggttaggttattcaatttctgaggggcagaaaaagattatagtagttaaggcttgagatcatgcattcagaataaaatacaatcactgatacataaactatattgaatgttatacaacatatttaaaggatgatatttaaatcaataatatataaat

SEQ ID NO: 308 - DNA, 572 bp, Homo sapiens
ttttaaatgacaacatttaatgggatgataaggaaataagacttgtgcaagaaaccatagcccactgcagactgttcacgatgtcagatggttcatgatttttttccaggtttgatacagaagaatcagtttgttaaaagaaatgcttctccatctttttcgtagtaatcgtagaccatgcctggggctggctgaatgttgaacacaaggttgctctgctcaacagaaaaagtgaaactgtctgctcgaccaaaaacattttccaagtagaaaagaacatggtcattcttgacttcagtcttcatcacttggcccttgttttcaagctcttcaatggatgacatggttggagtaaatcctgatagcatttttacatctataaccaccatactggatttattgcgaattccagtgtatttgaggttcactgtgaggtcaaaaacagtcaaagagtagttctttactatttccaaggaaagagaaaatccagatgccttcttaggtaggagaacattgtacttaagggtggccgtgataaatgtacaaccgcggtcttccacatctactgtgta

SEQ ID NO: 309 - DNA, 667 bp, Homo sapiens
tttttttttttttttttaatgtaaaaatcaatttattatacaacaatcatagataatgctttttatctacaaagagaaatggcttctgcagcctccctgtctactccattcatgatactatgttcttaagatataattactttcaaaggaaaacaaagcgatatccatattttccaaacaaggaagcccccagacacatttatgaacgatatggaaatattggaaagaactcaaatggactcctagatacaaaaggctgttctgcccatcacagtaaacactgttttgccttaaaataaaaataataaaatatttctcaaatgcaggggtgaggactttaccccgtaacatgcctaagtggttcgatatataattttgatggcttgacaattgctatgtttaattccattcagttaacattccattttgttagtttaaaaaattgggggaattattaatagatatgctttacagtatttaagtattttcattcccatgggtcagaggaaatttgagagaaaacattctccattttttttaatagattatacaaatattaatttttcaatagttttagaaaaatcacattaaaataagcattttgggtttttgaggttacacacttaacgacaggttaaaatgtttacctggattatttttttgtggc

SEQ ID NO: 310 - DNA, 607 bp, Homo sapiens
  modified_base (593)..(593): a, c, g, t, unknown, or other
aaatatttatttaaccacatgtatatacaactttctaaacttgaagtctgaatttgaaatgacgaatctttaaaccaaaagatacatataccattgacagagacacctatctatacaaacctagcccacgggaggctacatctgtagcaataaggatgggtgcctttccagaacggaactcattaagtacccaatctctttctggttgactcttgtctccatggatacacatagctggccaaccatctctgcgcatccttcgagtcagatcatcacagcgtctctttgtctccacaaatattattgttttgttttccttttcagccattatttcttccattagttggatcaacttgtggtctttttcactttccatgcagacatccactatctggaggatgttgtggttggcactcaactccagattgcctacgttgatctgggtgtaatcacgaaggaaatcctctgcaagctgtcttacttcttttggccaggttgcactccacatcagtgtctgcctatcaggcctgatttggtcaacaattttacggatctggggttcaaaccccatatcaagcattctgtcagcttcntccaatacaaggta

SEQ ID NO: 311 - DNA, 559 bp, Homo sapiens
tttttagggtatcaagattttacattactaattctgaattcgttatcctttgctttcagccatattaaaactgaaagccttccatacctgatgtttttctatctcattatacagctttcctgtcagatcttcttttagggtgactttgaagaatcagaacatcagggctccaactctcagtagagccagtaaccagcttcctgatttaaaaaaaatcacctttggcctaattttgtcacttataaacagtggtattgcagtaccctggtatgattagttatgatatgtttaacaataattttaaaataccaaagcttgtgaattattttactttcaaaaaattatgtaggtaggaatggtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttcacactgaggcacaaag

SEQ ID NO: 312 - DNA, 469 bp, Homo sapiens
  modified_base (13)..(13): a, c, g, t, unknown, or other
  modified_base (15)..(15): a, c, g, t, unknown, or other
  modified_base (108)..(108): a, c, g, t, unknown, or other
  modified_base (170)..(170): a, c, g, t, unknown, or other
  modified_base (367)..(367): a, c, g, t, unknown, or other
caggttctgaagncnttattgagaccttcagtccctacccactcccagccctgcagagattgtcctctgctccctcatgtggctaaacctctcaacacccagaggtantggggaagacctcatatgcatgcctaccttggctgtggctgtttcagggtggtgtgcggtantgtgttcttggcatagagcttcaggggctgggatgggccatcaggggaagctgagtatgatagtgaggtgggctggggttccacggtactcaccacaggggagtaagttggtgggagggatgctgaagatgggacatggtttgagagcagcccagaggagtgctgggctgtggcctaggaatacaccatgggccctnttcacactgcactgctcagcttagcacactagggtggcccagacaggggtccacagtgaggaagcaggacaagatggaccacaaaggcctgcagctgggagt

SEQ ID NO: 313 - DNA, 450 bp, Homo sapiens
  modified_base (26)..(26): a, c, g, t, unknown, or other
  modified_base (188)..(188): a, c, g, t, unknown, or other
  modified_base (202)..(202): a, c, g, t, unknown, or other
  modified_base (222)..(222): a, c, g, t, unknown, or other
  modified_base (362)..(362): a, c, g, t, unknown, or other
  modified_base (391)..(391): a, c, g, t, unknown, or other
  modified_base (409)..(409): a, c, g, t, unknown, or other
tttttttttttttttttttgcacggnttatttcctttaatctttgcaacaacccaaagtgtaatagtaagcacagggtttttgcgtgatacccggtagccttattaagaattagctcttattttcatcaaaggtagagaaaatgagtaactattgaggcccccgctggctccctacggaggcccccgntttcagccctaggngcctctgtcttgtagggctntataggacagtccggtcagcagttacctcaagctgagctgggcttgtaggttggggagggtggtgggtgggagaaaagttgatggggaacgcagcggttcccaccccctgaaacaccggcaatgctggccgtgggaattnttagacagtccctaaaaccacgtgatcgntgctcctccgcctccctntcattttgggcccagtgttagctccgcaggcgttcgcccgg

SEQ ID NO: 314 - DNA, 803 bp, Homo sapiens
ccggcacgagaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgaaaaaaaaaaaaaaaaaaaaaaaa

SEQ ID NO: 315 - DNA, 440 bp, Homo sapiens
  modified_base (403)..(403): a, c, g, t, unknown, or other
tttttttttttctgtttcaataaaactttattcacaaaaacaggtggcagggtagatttggtctctgtactgtagttcactgacccctgatctaaaagattacatactttgaaaacagcaatgccaaaccttgaatccaggtccgatattttccagcaatcgtgatgcttctctgatcaactgaatgaaacagttataaatgtactggctaaatttagctttatgcacttgttttgtcccctattacagtataaacttttggtgaatagggattttcaaattaattaaagcacttatttttatacccaatacacacaaatacagaactttactatagcagatttttgaccccaatttagtgtgctatctgaataaaaggcttagtaactaaaaaaagtgctgncttagatttctgaactatttttttttttttttttgga

SEQ ID NO: 316 - DNA, 546 bp, Homo sapiens
aaacataccaggatttttttatttttcagtgtaaaaatcaaacatgataaacctagaaaactatcagcagggctatttcttacagggttccagcaagggttagcattgttacatttcagaagctgactttctttaaaccatctttacagaggagtaaacttcacagttccacacatggctgggctccaggtagaactccataagagtgacgagggaaagtcaccactgggcagggagggcatttctgagaaatgcagatgagaggagaggctgtgagcacaggctgtgtcaaaacccagggcaagggctccctcccgccttccctcccagtgggaaggccaccctgagccccaaaccacattctgttccttcctcgtcattctgcagacaatggtcatccacagaccacacgtgtggtggctttggcaaccagaaatttaaaataagctatggtttttccagtagccaaaatgatcctgcaccaaagctcatagactgagaacctgagcatgcaaaaccacagtctgggtgaagggatgtctgctt

SEQ ID NO: 317 - DNA, 531 bp, Homo sapiens
  modified_base (238)..(238): a, c, g, t, unknown, or other
  modified_base (495)..(495): a, c, g, t, unknown, or other
tttggtttaaatgtcttttatttgcaccagtttatagaggggaggcagattaggtactatgtctttcaatggcatgtatataacatctagtcaaatacaggtgctccatcattacatcacttaagtttgaagttttttgttttctaattggcagattactttttgcttttgaatatttgaaacagaaatgctataaattgatcactgatccaacttgggcctataagagatcactatngttgtcattagtacaatttactttaaaacaggagcaaaaaacgtgtctgtcactccctgtttttgcaaaatctctccccttagttttatggtagtttagtgacattctgctgtatttcactattgtgagatgacgtggagccaaatgaagggccactttgatccattctttgatttcaaccccaaactttctgcaaatatgttttatttcctagccaaagttattttagatgccacatggcactatataaagaattntaatgttctagagtcttatgtactggatagtaaaga

SEQ ID NO: 318 - DNA, 574 bp, Homo sapiens
acaattacaagacaactttattctacccaacaaatgaatggcacatttttctataacaaagcaaacccatgagttttggacattctgatataaaaataggttattcgcctttttacagtgaccacttaattatagaagcagttactaacacaagtgtatttcaaataatcatgagttatgaaaacacattggaaaaattaaataacccaagagtttctcagcacaggaaaaacatggcctggtcctctctgcatgtgcactgtgctgccgtgacaacccagctgcccccgccgaggctccggcgtggccaggactgggcccagctatagcaatgggcactgtgcacggcctgggacagccaagctggcactgacctggaaaagcacagccctccaagcagccagggagcgctttcatggaacagcaaagcaacagcaaaaaccaccaacacttagacatcaagcggctcagcattttgtaaatctgatttccttagaaagatcatcaatgttgacttaccattacacaagtgaaagactcacaggggaacctaatcctgaaagctcaaactctt

SEQ ID NO: 319 - DNA, 2494 bp, Homo sapiens
ggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcc

SEQ ID NO: 320 - DNA, 904 bp, Homo sapiens
  modified_base (517)..(517): a, c, g, t, unknown, or other
  modified_base (526)..(526): a, c, g, t, unknown, or other
  modified_base (542)..(542): a, c, g, t, unknown, or other
  modified_base (727)..(727): a, c, g, t, unknown, or other
ttggcttttagaaagagaattttatttggaatgaaaatatagagcccaccctcccgcctcctctggggagggagcagagggctgggcagtggtcggggagatggtccctcagaggtcgaggagctcgcctgggcgtagacatcctccacaggaacagtgaggaaagctgggcgctggcttcggcctgggcctgggacgggtgggggtgggaactgacccctgcgctgcctcagaggctctgggcagccagctagcccggtgcgacccgctggcagaagctgagtgggaagggggcggcggaggagatgaaggtggcgtgtggctgtggccctacgcatccccgttctccatgcggcccagctgctcctccaggcggcagatgccggtcgccctgctccttgaccagcgccctcagggcccgcagctcctgcatcacctcctccagcttcccagcctccccggctctggccaggctgccgctgggggtggcatcagcagcagtggtggtggaggcggnggcccctangtgggaggagcccggngccatggcggggccgctgtcagacaacacgttgcgccggctgatcttcaggtcccgctgcttgctgggcacgtaggcctcccgcagtgagatgagggatcggtcggcatcccgcccgctcacccactcctcagcctccagggctgcctcgggccccgctggggggcgggtcagatcattcctggnagaggttcgactttctttgcccagtcatgacgatgggcttacactggcgcctcatgccagttgtggaccccggcgatcttgcacttgctgaccttccagccccgctttggcatgctgcccataccccgttgccgtttccttggtgggtgaacggttccagaaatggaggaaggaggc

SEQ ID NO: 321 - DNA, 3871 bp, Homo sapiens
aggatctacagcctcaggacccccgtcccaatccttaccccttgccccatcaccatcttcatgcttacctccacccccatccgatccccatccaggcagaatccagttccacccctgcccggaacccagggtagtaccgttgccaggatgtgacgccactgacttgcgcattggaggtcagaagaccgcgagattctcgccctgagcaacgagcgacggcctgacgtcggcggagggaagccggcccaggctcggtgaggaggcaaggtaagacgctgagggaggactgaggcgggcctcacctcagacagagggcctcaaataatccagtgctgcctctgctgccgggcctgggccaccccgcaggggaagacttccaggctgggtcgccactacctcaccccgccgacccccgccgctttagccacggggaactctggggacagagcttaatgtggccagggcagggctggttagaagaggtcagggcccacgctgtggcaggaatcaaggtcaggaccccgagagggaactgagggcagcctaaccaccaccctcaccaccattcccgtcccccaacacccaaccccacccccatcccccattcccatccccacccccacccctatcctggcagaatccgggctttgcccctggtatcaagtcacggaagctccgggaatggcggccaggcacgtgagtcctgaggttcacatctacggctaagggagggaaggggttcggtatcgcgagtatggccgttgggaggcagcgaaagggcccaggcctcctggaagacagtggagtcctgaggggacccagcatgccaggacagggggcccactgtacccctgtctcaaaccgaggcaccttttcattcggctacgggaatcctagggatgcagacccacttcagcagggggttggggcccagccctgcgaggagtcatggggaggaagaagagggaggactgaggggaccttggagtccagatcagtggcaaccttgggctgggggatgctgggcacagtggccaaatgtgctctgtgctcattgcgccttcagggtgaccagagagttgagggctgtggtctgaagagtgggacttcaggtcagcagagggaggaatcccaggatctgcagggcccaaggtgtacccccaaggggcccctatgtggtggacagatgcagtggtcctaggatctgccaagcatccaggtgaagagactgagggaggattgagggtacccctgggacagaatgcggactgggggccccataaaaatctgccctgctcctgctgttacctcagagagcctgggcagggctgtcagctgaggtccctccattatcctaggatcactgatgtcagggaaggggaagccttggtctgagggggctgcactcagggcagtagagggaggctctcagaccctactaggagtggaggtgaggaccaagcagtctcctcacccagggtacatggacttcaataaatttggacatctctcgttgtcctttccgggaggacctgggaatgtatggccagatgtgggtcccctcatgtttttctgtaccatatcaggtatgtgagttcttgacatgagagattctcaggccagcagaagggagggattaggccctataaggagaaaggtgagggccctgagtgagcacagaggggatcctccaccccagtagagtggggacctcacagagtctggccaaccctcctgacagttctgggaatccgtggctgcgtttgctgtctgcacattgggggcccgtggattcctctcccaggaatcaggagctccaggaacaaggcagtgaggacttggtctgaggcagtgtcctcaggtcacagagtagagggggctcagatagtgccaacggtgaaggtttgccttggattcaaaccaagggccccacctgccccagaacacatggactccagagcgcctggcctcaccctcaatactttcagtcctgcagcctcagcatgcgctggccggatgtaccctgaggtgccctctcacttcctccttcaggttctgaggggacaggctgacctggaggaccagaggcccccggaggagcactgaaggagaagatctgtaagtaagcctttgttagagcctccaaggttccattcagtactcagctgaggtctctcacatgctccctctctccccaggccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcaccctgggggaggtgcctgctgccgagtcaccagatcctccccagagtcctcagggagcctccagcctccccactaccatgaactaccctctctggagccaatcctatgaggactccagcaaccaagaagaggaggggccaagcaccttccctgacctggagtctgagttccaagcagcactcagtaggaaggtggccaagttggttcattttctgctcctcaagtatcgagccagggagccggtcacaaaggcagaaatgctggggagtgtcgtcggaaattggcagtacttctttcctgtgatcttcagcaaagcttccgattccttgcagctggtctttggcatcgagctgatggaagtggaccccatcggccacgtgtacatctttgccacctgcctgggcctctcctacgatggcctgctgggtgacaatcagatcatgcccaagacaggcttcctgataatcatcctggccataatcgcaaaagagggcgactgtgcccctgaggagaaaatctgggaggagctgagtgtgttagaggtgtttgaggggagggaagacagtatcttcggggatcccaagaagctgctcacccaatatttcgtgcaggaaaactacctggagtaccggcaggtccccggcagtgatcctgcatgctatgagttcctgtggggtccaagggccctcattgaaaccagctatgtgaaagtcctgcaccatatggtaaagatcagtggaggacctcgcatttcctacccactcctgcatgagtgggctttgagagagggggaagagtgagtctgagcacgagttgcagccagggccagtgggagggggtttgggccagtgcaccttccggggccccatcccttagtttccactgcctcctgtgacgtgaggcccattcttcactctttgaagcgagcagtcagcattcttagtagtgggtttctgttctgttggatgactttgagattattctttgtttcctgttggagttgttcaaatgttccttttaacggatggttgaatgagcgtcagcatccaggtttatgaatgacagtagtcacacatagtgctgtttatatagtttaggagtaagagtcttgttttttattcagattgggaaatccattccattttgtgaattgtgacataataatagcagtggaaaaagtatttgcttaaaattgtgagcgaattagcaataacatacatgagataactcaagaaatcaaaagatagttgattcttgccttgtacctcaatctattctgtaaaattaaacaaatatgcaaaccaggatttccttgacttctttgagaatgcaagcgaaattaaatctgaataaataattcttcctcttcactggctcgtttcttttccgttcactcagcatctgctctgtgggaggccctgggttagtagtggggatgctaaggtaagccagactcacgccta

SEQ ID NO: 322 - DNA, 543 bp, Homo sapiens
  modified_base (89)..(89): a, c, g, t, unknown, or other
  modified_base (120)..(120): a, c, g, t, unknown, or other
  modified_base (336)..(336): a, c, g, t, unknown, or other
  modified_base (375)..(375): a, c, g, t, unknown, or other
  modified_base (398)..(398): a, c, g, t, unknown, or other
  modified_base (422)..(422): a, c, g, t, unknown, or other
  modified_base (429)..(429): a, c, g, t, unknown, or other
  modified_base (448)..(448): a, c, g, t, unknown, or other
  modified_base (456)..(456): a, c, g, t, unknown, or other
  modified_base (469)..(469): a, c, g, t, unknown, or other
  modified_base (476)..(476): a, c, g, t, unknown, or other
  modified_base (482)..(482): a, c, g, t, unknown, or other
  modified_base (500)..(500): a, c, g, t, unknown, or other
  modified_base (505)..(505): a, c, g, t, unknown, or other
  modified_base (538)..(538): a, c, g, t, unknown, or other
ttttttttgtcatccaaacatctcttccttttaaaattttcttagagttaaaaccataaataagaggatttaaaccactaaaatgacangtgccaacatcttcattcagccagacctggnaaattctatcaaaactagacagttaaataagaaccacgttataaaaatattagccaaaaaaagactattaggataattctgcaaactcaaatatgaaactgtactaaacaaaatatgtgcaaaggtacacaagcatagagccacgttgggggttatgctcagattagttttaaaggctcgctctagtgggatttaattcaagagttgtccacggtnggtggtgtttactttgaactcacacaagttcaaagaatnataaaatatggcacaaccacttncccaaaaggtgttcttttgggagncggtggntccttcgtgttccacaccngggttaancgggggttttccnagggttngggagntcggggagggcaaagggnagggncatttttcccaagttccggggcccgggaaactncccgg

SEQ ID NO: 323 - DNA, 527 bp, Homo sapiens
cccccggctggtccccagcccgcgccgagtacccccgagtgcccttctctccgggcgcgggcaggacgcaggagcaggcggagtcggtgaggcccgacggctttattggttcagggcccagtcccgtcccctcgcccgcggacgcccgggtccgcggcgctcagcggctgtcacgggggcggcgcagctgccccatcatgtcggccagcatgcggttgcacagcgcggcgtaggggttgagcagcaccagctggcgccgcgcgaaggggctgcccagccgtgccgccctctcgaagtccctgcgggcgtcgtcgtctcggccctgcagccgcgccaggagtccgcgctgcacaaagctctggcgggcggcgcggccccggccgccgctcagctccaccgcgcgttccagatcctccagggcgccgtggttcttgcggctcccgggcgtggccatttacaacccgcctcgcacctgctagaggtacggatcgttattcccattacacagatgaagactgtggaagagt

SEQ ID NO: 324 - DNA, 1603 bp, Homo sapiens
gaattcggtccgctggcgcatgcggaagctcaagtacaagcacctggccttcctggcagagtcctgtgccaccctctcacaggagcagcactcgcaggagctgctggctgagctgctcacacactggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtgcccctgggccctcagcccttgacaggaaggagacccccctgcaaaaggagctgcaagacgctgaaggggctgctggggagcgccgacaagggcagcctcgaggtggccacgcagtatggctgggtgctggattctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccactctgagggacagaacgtcctcttgtgtataataaacctttaattttggtgttggacccctggggccttcccaggcttggtcaccctctgcactgtcaaaaaaaaaaaaaaaa

SEQ ID NO: 325 - DNA, 411 bp, Homo sapiens
atggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtag

SEQ ID NO: 326 - DNA, 3890 bp, Homo sapiens
atgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtccaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccatggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttgaagcgattcttgtgcctcagcttcccaagcagctgggattacaggtgcccgccaccacgcccagctaatttttgcatttttagtagagatgggtttcaccatgttggccatgctcgtctccaactcctgacctcaggtaatccgtctgccttggcctcccaaatgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaagatgctattcttc

SEQ ID NO: 327 - DNA, 8976 bp, Homo sapiens
agcgaagcggaggcataagcagagaggattctggaaaggtctctttgttttcttatccacagagaaagaaagaaaaaaaattgtaactaatttgtaaacctctgtggtcaaaaaaaaaaaaaaaaaaaaagctgaacagctgccagaggaagacacgttataccctaaccatcttggatgctgggctttgttatgctgtaattcataaggctctgttttatcagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaaacttttatagtaatgaataaaggaaaggcaattttccgattcagtgccacctctgccttgtatattttaactccactaaaccctgttaggaaaattgctatcaagattttggtacattctttattcagcatgcttatcatgtgcactattttgaccaactgtgtatttatgaccttgagcaaccctcctgactggacaaagaatgtagagtacacattcactggaatctatacctttgagtcacttataaaaatcttggcaagagggttttgcttagaagattttacgtttcttcgtgatccatggaactggctggatttcagtgtcattgtgatggcatatgtgacagagtttgtggacctgggcaatgtctcagcgttgagaacattcagagttctccgagcactgaaaacaatttcagtcattccaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtcacttttatgttttggatgggcaaaaagaccctttactctgtggaaatggctcagatgcaggccagtgtccagaaggatacatctgtgtgaaggctggtcgaaaccccaactatggctacacaagctttgacacctttagctgggctttcctgtctctatttcgactcatgactcaagactattgggaaaatctttaccagttgacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggcagttgcggcagcatcagctgcttcaagagatttcagtggagtaggtgggttaggagagctgttggaaagttcttcagaagcatcaaagttgagttccaaaggtgctaaagaatggaggaaccggaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacggcaccaccactgaaacggaagtcagaaagagaaggttaagctcttaccagatttcaatggagatgctggaggattcctctggaaggcaaagagccgtgagcatagccagcattctgaccaacacaatggaagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactgcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggttctgaacctctttctggccttattattgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagagaaattaaatgcaaccagctcatctgaaggaagcacagttgatgttgttctaccccgagaaggtgaacaagctgaaactgaacccgaagaagactttaaaccggaagcttgttttactgaagggtgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtttctttggttagcctggtagccaatgctcttggctactcagaactcggtgccatcaaatcattacggacattaagagctttaagacctctaagagccttatcccggtttgaaggcatgagggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggccacatttaaaggctggatggatattatgtatgcagctgttgattcacgagatgttaaacttcagcctgtatatgaagaaaatctgtacatgtatttatactttgtcatctttatcatctttgggtcattcttcactctgaatctattcattggtgtcatcatagataacttcaaccagcagaaaaagaagtttggaggtcaagacatctttatgacagaggaacagaaaaaatattacaatgcaatgaagaaacttggatccaagaaacctcagaaacccatacctcgcccagcaaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtttccctcagacactactacttcactataggctggaacatctttgactttgtggtggtgattctctccattgtaggtatgtttctggctgagatgatagaaaagtattctgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagaccgtggggacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgtgtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacgttgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctggatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattgggctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggaaaaaaaaaaaaaaaaaaaaaaaaaaaaa

SEQ ID NO: 328 - DNA, 613 bp, Homo sapiens
tttcctttcccctcctttatttttactaatgaattggccactgatacacaaatggtgggtggacaggctctcatttctcaactagttttatagaaattaaattaaaaattattcctgtggaacaatgctcattgcccacttctgattcattaggaaaacacatcctattttgaagccagtgttttgaaagacagttgaagttccatttcaaggactaagcatcagaagcactccttatgaattcacacacacacacacatacacacacacacacacaaattgacaaggcagcactgctgacaggctattaagggaaaccggatatgctagtatttgttgaaatgatcattaatttgcttaaatgctgaaaacttcagatatgtaaacatccacactatttgaacattttttagacatcaaaggattttcaagtgcttctctctggcttgcatttgctaacattgcagcagcaacagcgctggagtagttgaaaagggatgcattaatcatttgtaaaatgagagagcagaacaagattatgctttcttaagcagaaatacatgagccatggatggcttcagggtctttggatcctatgaagccatcaaacaaa

SEQ ID NO: 329 - DNA, 436 bp, Homo sapiens
tttttttttttttttgtagtgtctgtagtgtttccacctctgacaagtgcctgaggatgcacggagggcatgaaagggctagccacacaccttgctctcccaggttctcctctcactcctccatcctcccgagactcacttctgccgaagactctgcagctcagcccagaactcctcatcttccccactgctttctgactcctcgctgctcaaacacaggctgctgtaggagtagttcatccacactgggctgggatggctcaggggttgggggctgcccccaacttggggttccttcccatcatctccttcctcctcaactccagcccccagaccctcagctgcacggtcgctctcagccagagcttccctggtctctggcccgcctccagcactgtcctctgtatctgagctctctgaagtgagctgaggggtt

SEQ ID NO: 330 - DNA, 482 bp, Homo sapiens
ttttttaaattcatacttttattattagggggtaggtaggggtcattttgttgtttatgtacacttcatattttttcaacgaaagacaaaataagattaataaaatagaaatatatgctcagtgttataaaattaaaaagtagttgttctaacacttaaggctattgcagttgctgtatttaaggaataaatttgaccttgagtttcctgacagcgaaggtaaaaatggaacatgatgttgtggttaatacagttatataacgaatcacccccaaaacttagagtaagctgaaaacaaccacttcttacgctcatgagcatagcagagataacttaatcatcctgttcacaaggtttggagctcagcaggaagattcaacagctggaagctgggaccatctgaagattcactcacttgtctgtctagtgattgatctcaactgtcagctaaaatcttagctgggacaacttcctaaaacact

SEQ ID NO: 331 - DNA, 1230 bp, Homo sapiens
catagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtgccccccacccgggtcccgggcccactggccccccgcagacgccgctacacactgactccagccaggctgcgctgggaccacctcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgttgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgaaaaaaaaaaaaaa

SEQ ID NO: 332 - DNA, 1090 bp, Homo sapiens
  modified_base (194)..(194): a, c, g, t, unknown, or other
  modified_base (437)..(437): a, c, g, t, unknown, or other
  modified_base (444)..(444): a, c, g, t, unknown, or other
  modified_base (457)..(457): a, c, g, t, unknown, or other
  modified_base (626)..(626): a, c, g, t, unknown, or other
  modified_base (662)..(662): a, c, g, t, unknown, or other
acaatttatttccgagtacccgccagaccaccaggctgagcctgtgacgaccgcctcaagggaccagccattcctgttcccagtgctgcgagccacaggcctgggatccggccagagtgagcgcagccccacccctggagcgagcgtgtgacgggggcgctgcatctgcatcgtccctgcggccacctggcctnggaatctgcccctccaagacccagccaggctgggccagggcaggcttcccacacgagggcccgtggacagggccccagcgtccaggtggcgggakccagaggagaacagggcgggctcccaccagcctggccagttcctgccgacactgttcctgtggtggacgtagcaccgcctccaggcaggcctccbggctcctcagcgtcctgatcaccacagcggcccgcaggtcccggtcccctgcngccccancctctcgtctcancagccggtgtggcccagggggctgggccgggccaccgtctcgctcccagcactgctgtggagctcccagccccttttccacagcctcccgagaggcccgccgcgcgcacttcactttggcccccgtccacagcctccagccttggcctcccaggccgcccgcctgcgcnccgcagcctcccgcagctcctcctccagtgcctgcngcgcccgcactaacaggaccaactcgccaccaccgcgctcggggacccagggcaggaaggtgggctgtkaggytgcagcaggsacctycggggcamaggtgchcaggaccgtgttcattcaccgccagaagaacagcwcagagcgccgccacgccagggcagcytccaggcgctggttctcacgcyccagagttcgcagcagccgcyggcctycctctgggttcctgagcatcttcgcttcagttaaaraaagaaggctaaggctctggtcgctgtggcagccgcgtgttttcaggtggatmttgcccaggagggcgcmctgctcccsccgahtgggmamagcdggggcmaacggaacgcagcrtthcaawaacaatwcaaaaggggraawcaaaggmcttttcttcattttgggggagggggcaagg

SEQ ID NO: 333 - DNA, 489 bp, Homo sapiens
ttttctgtttcagacatttatttccatttaaatgacactttgaaagatcgaggagccaatctgtaccgcaaagacaacttatcatcaaagactctagaagtacaatcgtatcaattcacaagacttgatttcttcaacttaaatgatagcttttagttaaaatatacctgagagaagaactccaaaggatgcctgcctcataatctgccctggacttgtcattcccgacaggacacctcaatggacactgccccaccccattaagactctgaagcgtagggtcccattgctttgcttccgaaatccaaggggaacaagaagtacccatctcttacaaaaataagcatgtcaacattgttcagtacatttttctacacatataaaatcaaaataaattgtaaaaatatttttccaggtacaaaataaatatagaaaacatcaatgtaaaaacaaaaggattgtccgattcagaccattaccttgccaatt

SEQ ID NO: 334 - DNA, 598 bp, Homo sapiens
gactcttcaatgaaaatgtatttcacattaaacacaaggtacatatcatgcaaatgaggcatcaccatggtcacaatggtgctgtgaggtacaacaaatcacaagaaaacagacatttagcaaaataaggttccaggaaagatgagaggcattttctgaaagccagaccatgctatggtttctgtgtgcctgtcataaagggacttggccagtatttgccgagatggacagcaccgcattatgtggaggcatgtactttattgagtagagacacatacacagacatataatttctgtaactaatacattcttaaatgtagctggctgtaaaagcacatgaacaagattactactgagacttctttgtatctcctggttgcaaacctctctcagaattatgaatctttccaaacccttaattatacaagtcaaaacaaaaagtttcaaagaagaaaaggtcattttaatttgaaagccacatttcgccacaagaaacaaaattaagaaaacacaccattatatggcataaaatgtgtggagtatacattctagtgtcatttttcccattcagattttttcttgaagtccattaaagtga

SEQ ID NO: 335 - DNA, 580 bp, Homo sapiens
tttttttttttttttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttctttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaa

SEQ ID NO: 336 - DNA, 485 bp, Homo sapiens
tttttagcaagacaaggtgtttttattgaggtctcaggaattgcaatttgggagacagattcagctagaagccacttgtgttctgaagagagagggtagaggaggggtttttaaaaaaagctgagggtgattagacaagttgacaagttgttttgaaagaggcaactggcttagtacaaaaatccatagtttattggttggtgctgttgaggagttgtagtgctggtgaaataaaattttccaggatgcagtggtcatcgcaatttggcccaattcaaaggttcaaggtaagctcctgtattgtttttttttttggagcttttaattttttttcaagttgcaggtcatgtagggagtcctttttagaatggcttcctccctccattttagagttctgaaccaaagtgatgtcatttattttattttatttatttattttttaagatggagtctcactctgtcacctaggctggagtgcagtggcg

SEQ ID NO: 337 - DNA, 1908 bp, Homo sapiens
gggacgtcagcggacggggcgctcgcgggccggggctgtatggggctcccgcgcgggtcgttcttctgggtgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagcgctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcac

SEQ ID NO: 338 - DNA, 1192 bp, Homo sapiens
  modified_base (940)..(940): a, c, g, t, unknown, or other
gcttaccacttcaggatgactatcctccctccagtggagaagctgaaacacggtgctgcagaaggtgacagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttcttttgtgccttgatgtcgagagcgcctctcttttgagcaaacaagcattctatatgcaaccagagtagaggggacctgctcagccaggtgtgaccagggttctctgaatctgtcactcgtcaagcttctggcaacgttcactctcggggtttacaaaccaactagcgactgctgtcgcggctgagactcgctccacactcctgccccacccgacccaccgtgtccgcgccccccggtcgtcgccttaaccagtgccgcacggcgccgcccccccgcaaaacccacccacccatgcacctgctgaacactcaaacgcccctccacccgcccgcagaacccatcccgcctccctccgacaccgcaacgggcccccgcaaagcgccccacgccacctgcaaaacacccgataacagcaacagcgaagagccatagagccaagccagggcagcacacgccaccgcccaacacacacgccgacaactcgcgccacccacacgacacccaccaaacagcacgacgctacaactcccgaacaagccagacacacacaacgccaaaacagaccacaacctgccgaaaagacgcgacacgccagagccccacacgatgactggacgaacatgggaccatccgcgcagcacacagccaacagcacagcacggaacagcgcacacaccccgggcaacncccgcgaggccactagagagacaaacacggagcgcacccccgccaaccacgccaccccgatgaccccacgacgcaagacagcccacgcgccacccaacagcgcagcctcacgcgccacaccggcgcggccacaccacggcggccacaccaaaccggagagggaaggtgaccaaccaagcgaggaaccgacacacaacacacagaagaccaaagcgtagcgaacagcgaccgccacggcccgagcacacaccc

SEQ ID NO: 339 - DNA, 5691 bp, Homo sapiens
atataaactctaaggaagacagtgatggagtgaagtgggctgggggcgatagagaggatggggtggggcaccaggcgagagatgcgaaggaagccagaacgaaaagagagcgaccgaggagagaagagagcagagcaatacaaaagcagcctcggatctagccggagctgcaagcgttaaggggaggcggagagtgacgcggtttgcgtctggagcggctccttggagtccacagcatccaccgccggagcctcgccttcctttctccctctgcagacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattgagctacggatcctgctgctgtgtggtagtgacctgctggagtccttctgcatcccagggctctggaacgaggcagatatggaggtgattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgggtgagggaatggggtgggagtcgggggaagtgcagtccttggagatgtactggtgtccgtctcccagcatgctctagagaggcggctctggtgcccatcctcccagcacgctctggggaggcggctctggtgcccatcctcccagcatgctctagagaggcggctctggtgcccctcctcccagcatgctctggggaggcggctctggctcttgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgtgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggaactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgcwaaaaaaaaaaaaaaaaaaaaaaa

SEQ ID NO: 340 - DNA, 561 bp, Homo sapiens
  modified_base (534)..(534): a, c, g, t, unknown, or other
tttttttttcaaattttattttttgtacttttattgaaaaggtacatttaaaaaaatacacagacattttaccatttacaggttgcagatatagatgctctaaaagagtccactctattttgttgttctatgataactcttgcccctgatatcacaaacattccagtcttgttgatatcggcttaaaaaggggggcatgggagcatgacctgcaatatattcagcgaacagaaagacaaattgttcaattataaatttttttatcttctgtacattattgcattagggagccacaaaattatgtagcatcattacaaatgaaaacaggttaaaaatgaagaagatacttatatagaaatacatggattcattgtcttcttgcagaatgcacaagaggtgcaaaaatgtgcaatttaggaagctctttttctgtttgtatacgtttgcttagcaacacaaaccagtgaggaagctacaaaataagttaaacaaaaatagcaaacaggtagtaattatagctatgttatatggctntctatttcatttaaatatctccaaata

SEQ ID NO: 341 - DNA, 2268 bp, Homo sapiens
  modified_base (13)..(13): a, c, g, t, unknown, or other
gggatttgaaccncgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaatatcttgtaaatattcctgtattctcaacttttttccttttgtaaatttttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaaaaaaaa

SEQ ID NO: 342 - DNA, 1640 bp, Homo sapiens
cgggacgagggggcggcccccgcgctcggggcgctcggctacagctgcggggcccgaggtctccgcgcactcgctcccggcccatgctggaggcggcggaacccgggggacctaggacggaggcggcgggcgctgggcggcccccggcacgctgagctcgggatgcggacgctgctgcctcccgcgctgctgacctgctggctgctcgcccccgtgaacagcattcacccagaatgccgatttcatctggaaatacaggaggaagaaacaaaatgtacagagcttctgaggtctcaaacagaaaaacacaaagcctgcagtggcgtctgggacaacatcacgtgctggcggcctgccaatgtgggagagaccgtcacggtgccctgcccaaaagtcttcagcaatttttacagcaaagcaggaaacataagcaaaaactgtacgagtgacggatggtcagagacgttcccagatttcgtcgatgcctgtggctacagcgacccggaggatgagagcaagatcacgttttatattctggtgaaggccatttataccctgggctacagtgtctctctgatgtctcttgcaacaggaagcataattctgtgcctcttcaggaagctgcactgcaccaggaattacatccacctgaacctgttcctgtccttcatcctgagagccatctcagtgctggtcaaggacgacgttctctactccagctctggcacgttgcactgccctgaccagccatcctcctgggtgggctgcaagctgagcctggtcttcctgcagtactgcatcatggccaacttcttctggctgctggtggaggggctctacctccacaccctcctggtggccatgctcccccctagaaggtgcttcctggcctacctcctgatcggatggggcctccccaccgtctgcatcggtgcatggactgcggccaggctctacttagaagacaccggttgctgggatacaaacgaccacagtgtgccctggtgggtcatacgaataccgattttaatttccatcatcgtcaattttgtccttttcattagtattatacgaattttgctgcagaagttaacatccccagatgtcggcggcaacgaccagtctcagtacaagaggctggccaagtccacgctcctgcttatcccgctgttcggcgtccactacatggtgtttgccgtgtttcccatcagcatctcctccaaataccagatactgtttgagctgtgcctcgggtcgttccagggcctggtggtggccgtcctctactgtttcctgaacagtgaggtgcagtgcgagctgaagcgaaaatggcgaagccggtgcccgaccccgtccgcgagccgggattacagggtctgcggttcctccttctcccacaacggctcggagggcgccctgcagttccaccgcgcgtcccgagcccagtccttcctgcaaacggagacctcggtcatctagccccacccctgcctgtcggacgcggcgggaggcccacggttcggggcttctgcggggctgagacgccggcttcctccttccagatgcccgagcaccgtgtcgggcaggtcagcgcggtcctgactccgtcaagctggttgtccactaaaccccatacctgg

SEQ ID NO: 343 - DNA, 569 bp, Homo sapiens
ttatgtacgatttcatttatatgaatgtccagagtaggcaaatccatagagacagaaaagatatcagtggttgccaggggataatgcagggaggggaagaggagaatgactgcttaaaaggtttcctcttggggtgatgaaaatgttccagaactagatagtggtaacagtttcacaacattttaaatgtactaaagtcactgaattatacactttaaaatggtgaaaatgatgaattttaaccattcatagccatgttttatgaattttaccattttttaagtaaagggaaaagaaggttctgagattcaaacctttgcaatcaaaataaactgtcgaatacagaagcccgtaaacatgttctgaatactatttaatttttctgcccatgaaaccaagcctaattctaaataatataagagccaaaataaactgtctaagctggtattaacctttttcttaaattaaaaatgttatcaggttgataggtgcagctaaccaccatgggacacgtttacctatgtaacaaacctgcacatcctgcacatgtatcctggaacttaaataaa

SEQ ID NO: 344 - DNA, 582 bp, Homo sapiens
ttccagatcaaattattatttatttcaataagactattgcgaggcattaaaaaaactaaatagtaatattacaaaatctatatacttgcacatttagtatttgtcaatgtgccagaggttttcttcatgaaatttgacttctttgaagtgaaggcttttttctatcatctcttatagctctgactgaataagtcttaatgctttcttcatgttttctatcaataggggtaaatcccgaggcttatatgtgtacaatctgttagagtatcttccagctatgtcagctctaactgttaaagaagggtctacaaacatgattctaggcacatattgcccatcaggtgataaattcttatcagtggtttcatgcataaggtttagcatgatgaacttattctgagccatttcttgtatttcttcattttgggcaaatactttctttagtgcttgagagtattgacaatcctccaggtgatgaataaccattaatggcttcttacttttttgagcataaaagagaccttgctcataagtttgtacccaagagatggcatctacccatcctcttgagagtgactgagg

SEQ ID NO: 345 - DNA, 507 bp, Homo sapiens
tcttggttctcagtgttggaaagtaatatggtaaaacttctcttctccgaggacaatagaatagtatttgttgtatagactgaaccatcctccaaaatttggaagtcaggatcacttgaatgaattagatttgcagctgtaaagcactctttcaggttaactctaccaacaagtttctcggcatctagtttggagggaacatgtaatgtcacatttttgcaggcatcactggcaaatattaagatcgcgagggtcagcaggagcagccggcagagggctccgttccaggagccggaggggcgggctgcctccatggagagggctcggggcaggtcgcgggccgagcgtcgggccggggtaggagggctccgcggggcgagggccgcggccggagcgcagtctgggcccgctgctcatgaggagcgcgaggcggaaggaggtggggcgcgcggagaggtgcttttcttagcttctctgaagcgcctgcctctcatccaaggggctttt

SEQ ID NO: 346 - DNA, 1873 bp, Homo sapiens
cgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcttgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatgggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 347 - DNA, 2115 bp, Homo sapiens
gacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacaccatcagtaggataactgcaaacatggaaaatggagaaaatgaaggaacaattaaaattattgcaccttcaccagtaaaaagctttaagaaagcaaagaatgaaaatagccctgatacccaaagaagcaaatccctcatgcactcgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaacaccggaaaaagagaaacagaatacggcaggagaatgatatggttgattcagcgcctcagtgggaagctgtattaaggagacaaaaggaaaaaaaccaagccgaccccaacagcaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcacgcattctcattcgccaaagctttattagtgcttgacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccattcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaag

SEQ ID NO: 348 - DNA, 596 bp, Homo sapiens
gaaacaaaactgaggactgtttatttcattgctcattcaaaacattccatgaaagactgccttaagtaatttcaaaggcttcactgatacatatgggggtggggagggaagctccactaccccatgccacaaaactatttgatataactaatgacatgcaaacacaatttgcaaaagcagagcattatcacaatatgacatttaaaaaattggttgagtaaacagatttcatatctttaaaacataaaataattacactgtattgagcctgggaaatcttggcaatatctacaaactttctcatttacagataggaacaaaggcccagagaagttaagccactcatccaagctcactgagcagagattctgcatttgctattttggaataagttgtctactttcaaatggttttttaaaatgggtattacatactttttgtttgtacagaacagtcatataaaatagttgctccttaattgtatccattactatttaatcgctcatttttctgtaatactattacttttttaatagtcacctatttcactgaaaggctccactggatttgaaaaccagattcagaaacatggcaca

SEQ ID NO: 349 - DNA, 5677 bp, Homo sapiens
cagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctccggtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattctgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 350 - DNA, 1246 bp, Homo sapiens
ggaaagattaagctccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcagatcatcttgctcacagggaaccaaagtcacaaaagcccttcagaaaaatgcaggaagaggagggggaaagttggagcaccagcagtgaccttaccatttcaataagtgaagatgatctgattttagagagcccagaaccacagccaaatccaggtggcaagatggagggagaagatggaatagaggccttaaaattaatccatgctgagcaagaaagagttgccctatccactgaaaaaaattgtattttgcaaaccctaagctctcctgattcagaaaaggaatcctccactaacgcaccaacaagagaacctggacaaacaccagactcagacgtaccgagggcacaggtgggtcagcatgttgccaccttgaaagaacatgataattctgtcaaagaagaggcaacagcattattgagaaaagcccttacagaagagtgtggccgtaggtcagctattcacagtagtgaatcatcttgcagcttgccatctattctgaatgacaatagtggaataaaggaagccaaacctgctgtatggctcaacagtgttcctacaagggaacaagaagtttcaagtggctgtggagacaagagcaagaaagaaaatgtggctgcagatatcccaatcacagaaacagaagcctatcagttgctgaagaaggccacccttcaggataatacaaatcaaactgaaaacaggtttcaaaagacagatgcttctgtgtcacacttgtcaggtttgaatattggcagcggtgcattcgagacaaagacagctaacaaaattgcttcggaagctagtttttcatctagtgaaggaagtcctttgtcaaggcatgaaaacaaaaagaaacccgtgatcaatttaaaatctaatgccctctgggatgagtctgatgacagtaactcagaaattgaggctgctttacgccccagaaaccataacaccgatgattctgatgatttttatgactaacgtgctgtgacattggtttcaaataaagtctttaaacaaactaaaaaaaaaaaaaaaaa

SEQ ID NO: 351 - DNA, 5597 bp, Homo sapiens
cagccacgacggagcagcagcgggactggccgccccgcgcccccttcgccgccgtgcccttccccggcgcgctcaccccgttctcgggatgggattgtagcggcggcgcggactcggcggggatcgcggcggaggcggcggcgtcggcggcggcgtcggcggccgagcggggctccatgttttcccctggccaggaggaacactgcgcccccaataaggagccagtgaaatacggggagctggtggtgctcgggtacaatggtgctttacccaatggagatagaggacggaggaaaagtagatttgccctctacaagcggcccaaggcaaatggtgtcaaacccagcaccgtccatgtgatatccacgccccaggcatccaaggctatcagctgcaaaggtcaacacagtatatcctacactttgtcaaggaatcagactgtggtggtggagtacacacatgataaggatacggatatgtttcaggtgggcagatcaacagaaagccctatcgacttcgttgtcacagacacgatttctggcagccagaacacggacgaagcccagatcacacagagcaccatatccaggttcgcctgcaggatcgtgtgcgacaggaatgaaccttacacagcacggatattcgccgccggatttgactcttccaaaaacatatttcttggagaaaaggcagcaaagtggaaaaaccccgacggccacatggatgggctcactactaatggcgtcctggtgatgcatccacgagggggcttcaccgaggagtcccagcccggggtctggcgcgagatctctgtctgtggagatgtgtacaccttgcgagaaaccaggtcggcccagcaacgaggaaagctggtggaaagtgagaccaacgtcctgcaggacggctccctcattgacctgtgtggggccactctcctctggagaacagcagatgggctttttcatactccaactcagaagcacatagaagccctccggcaggagattaacgccgcccggcctcagtgtcctgtggggctcaacaccctggccttccccagcatcaacaggaaagaggtggtggaggagaagcagccctgggcatatctcagttgtggccacgtgcacgggtaccacaactggggccatcggagtgacacggaggccaacgagagggagtgtcccatgtgcaggactgtgggcccctatgtgcctctctggcttggctgtgaggcaggattttatgtagacgcaggaccgccaactcatgctttcactccctgtggacacgtgtgctcggagaagtctgcaaaatactggtctcagatcccgttgcctcatggaactcatgcatttcacgctgcttgccctttctgtgctacacagctggttggggagcaaaactgcatcaaattaattttccaaggtccaattgactgacgcccttgacagccatctacgactttattaacaggttactgtgaagattttgccactaactctagattttacctttttgtaatgctgtttatcagaggagggtgacaggggctggaaataaagagaggggacatggtgatgaaacatggcaggagtgtaacagataccagtggtgtgttgcatgctcaaaacagcagcgtcgtcattgaagtctgcttgatccaaccataatatctttgtaataattggatttaaaatgctatgcttctatttttaaccttgggtttttaaccaagtttttttttttttttgtaatcttggacaagactttaaatcatattttacagatgtagaagaaatttattcaaaagtgtgggctcatgaagttcacttcagtgcagtgtggtgtaggtgttacgcgaagggcgcacagtgtctagaaatacttgatcgtggctcaaacctgaccagacagcagaggggcggctctgtacagtgtgactggtggacagatggccttaggcacaggtggttttgaaatctggggctttttctgatttatttttctgacttgttgggggagagaatattcataacttgtgggctttttttttttttaacttcagtggaatttactttagatattcattcatcaaatacatgggacttcacaaacaattttccataactttttagcctgtcttttgttatttctgcctaatatgatttgccccgatactcatcttgcacggccagaactgtttggttgattaaaatacatcagctcttaaaaactcattaactgagggtaattacagtagtagacatggtctgggtactatactaccatgtttatttgctgactgaattaagatttaagaatgattaaaaataagcttttactttttaaaaccacttgaggtttcataaagcttggggtttttttttttcctttgttaagaaagccaaccaatcacaatgatatagtcattgttgtgcactcccttttcaccatctgtcaccttcccttgcagcttaaggagcccagtaagttttgaaaatgtttgcgaatcaaactaaatttaagtgggatgattagatatacacaacaccaagtggtacatctgcagagataattcaaaattcctgcttttgagagagcaaatgagtgtttgctgaggaataattaaatgagaatttcataggagctccaccattcctgttactttcatttcattttgattaataattcttggatgcttggcatcgatcgtatcactgctcctagaaggtaaagatcctttaggacatgagactggtagaagctggctgagataaaataagtatttatttaaactaatgttctcttaatttgaccattgcagatttgggtgacttttttttaacctttgtacatatacgtaatttatatgattctaatgtactatatccatacttgaattggttttttcgtattttgcctactggcaaatattttgcctattttcagtcgttctaacctatttgaatacgcttttccttaaagtgatacgataatattactcttgattgctgctgcttaatttgatgtaatatgtttaaagttcagcctctcagttttaatatagctttatttttcagtggagatcattgtttaggatgagacatttttggttttggttttgtttgggtaaattttaaatggtgtgaaaatcgatgacaacagtcctcttacagatagcttgctgtattctgtatagcttactctacctgcagacagaaaatgaaagaaaaaaatggacttgcctagaataatatattgaatgccttttgatttagccagagtctctgatgattagctttcgctgatagagtatgtcttttcagcctgtaattctttgggccccaaagaatgacaaaggaggcactcgttctcttttcttgctgtatgcctagaaagtggttgaaggattcttgatgccctaaaaccatcttgtaagctaaatggtcttgcatccagaaaggccagattttacctaccaagaaaaaaagatatttttccagagagttaggtatatcataattttccatttcaagtcctgtttataagtctagtcattctgcaacgtgacatatcccccaaaatgaagttaccttccaagttggacacgtcccgtagttgggcatatgtctaactaaaagtttctgacttttagtaaattcagcttaaatataagttgaaatttgggaaataatttccaagctcttggaaggggtaacagtgaaccgccctccatgggctccacatcttttcctttggcttccaaagtcaggtcccgcccaccctgcctaaggaactgcagagaggtggcaaatcagcaaaaaggacaccaggctcttcttggccacttgtaggaagatccctttacaattttgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaataatcggtgctgccgggtcatgcatgctgcaactctcaacatttcccttatttggttcagcttttagcaaaaagggctacagttcaccctgcagagtattaaggtttctggatttttttctcccaactgtggcccaaaagaattaaaatctgttaatataaatagagaacatatttatcattcctcgatagttaattatagactttggtacctttgtgcctcagggaagccacgtgatataactggttatagaatttcagggttagggtttaaagaaaggagaaagccattggaaaaatgatgggctccattaaggagactaatgaatctggatgcagaaatatgtcagaaactggcataaacatgattgtagtagaatttattttccagtaccaatagggaaattattttaagttattacatttactgtattgggaaacttgaggagaactctttagttcataaagcttcaatgtctttttttttttttttcatggaaaaactcaaacctctgttatttgggagctcagtattgtgtggacacttacgagagttttctgcttaattgaagtgtaatataggttgtagaattgttacctgcagttctatggttttgtttcacttcttttcttttttaaagccattctgttctttggatgtgcttgaaagggtgtgtgattacaccattgttaatgctgggtaaaaactatcttcttgcagccttgcctcataacagtggaatttctgatagacaaaccacaggactttgattttaagccaaatccatctccatccctttactgtcaatcttctgtcccagtagtttagcctttgtggcttaggttatgatgcgcctccttctgtgcgaccaatgagacgacttcagcatctttttaaaataatctaagcatcattgaagcagtaacacaaaaaaaaggttcagtattttctttttagtataacttacatcctttcaaataagtctttgccctcatgaagaatccctagaggaagataaggaaaataagtattttccagttttgcttgacagtttctaaacaaacaaaaataaactcaatgaaaggaaagatgtttctttttagctgagatgacagattgcttctctgtattaaatagtctagaagttaaggggatggtcacatttaccatgtattgtgttattagcagttaaattttatgaatatgtttgtaaaattgttgttttatatttcatgtcaaattgaaaagtttatttcttcactattgtacctgtggaaatacaagccattttacaggaaaaaatcttcaaaaactattaaatggatatcagcctgaaaaaaaaaaaaaaaaag

SEQ ID NO: 352 - DNA, 2275 bp, Homo sapiens
ccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagacgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgccggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccatagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgcaaaaaaaaaaaaaaaaaaaaaa

SEQ ID NO: 353 - DNA, 604 bp, Homo sapiens
  modified_base (574)..(574): a, c, g, t, unknown, or other
tacatgtatcacttaatcctcacaaccacctgaggattaatggcatttacctgttttacagataaggaaaacaatcatttttcaattatgactatgcccccaaacactggtttggatggagccttcactggtatagagaatgaccttcttcccttagactagactctggctataataaaggatggtttaatcatcccctgaagcaatgcataagataatctgcaatgtatcttcacatactgtaccttatttgataggcaagagacccataaaggaagctgagcatggattatcagcttcatcacaaatctgaagaaactgacatttatgttatgttgccttacccaagttgggacatcagagcagcaactaaaatccaggtcttcttcctattacatgccgtaaaaggtattgtttctttccctcccctcaaaattttcagtcaaatgtcagcttttaggaagagccaatcactctgaactagaattgttctcttcacttaaaatttctcaagcctaacttctttttgggtcctacaagccgggaaaatacctcagaattggaaccacatgtntacagtataagaaatgacacaagtgtgact

SEQ ID NO: 354 - DNA, 672 bp, Homo sapiens
  modified_base (629)..(629): a, c, g, t, unknown, or other
aaccctgggctccagacaccccagagtctctttattgaggttcttagaaggcgagtgcaatctcagcctatggtaactgaaggaggtccagttcgtgttaagtctgtgttcaggaagtaggtgcagagctgccctttgcctttcaccttgatgacaccccggctgtagcaggtgtagcccacggactgtaaggcccatgctgtctcctcagtcacttggattttgccaaggactcctgtactctccatgcggctggccacgttcactgcgttgccccaaatgtcatattgcggtttctgggccccaataactccagctactacgggtccatggttcaaccccactcgcaagcggaagttggtgaatgaatgcttgttgatgacgtccagcttagaccccagggccacggcaaattccaccatagtgccaaggtggctgcagctccgttcagcattctggtgtgcattctgttcagaggttgcatttaagcctgtggcttgcatgtatgtgctgccgatggtcttgatcttctccaccccactgaacttgggcttggagagcagctcatcaaaaatagccattatcttatttgggcagcctaaaccactttatgccctatgattgatgtnggattcagagtagaactccttgaagtctgggactgagcgcaaa

SEQ ID NO: 355 - DNA, 3323 bp, Homo sapiens
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttcaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagccctaagaaataaaaaaaaaaaaaaaaaaa

SEQ ID NO: 356 - DNA, 289 bp, Homo sapiens
  modified_base (214)..(214): a, c, g, t, unknown, or other
  modified_base (216)..(216): a, c, g, t, unknown, or other
tttcacttttaacgctcaggctgtatatttcagttccccccaaggccctcgagacggacgatttgccaaaataaccaggttcagtggcttctgtaaaaagtcacttcctctcagcaggaaaggcccagtttcgtggggctgggggagctggggcagtccgcctgcagcccctgaggtgggaagggtccccaggactaggcctttcccagcgggngnattggggaggggagggacaggagccaccttaaaagggaaaaggggggcggtccccagggcgagcactcccgct

SEQ ID NO: 357 - DNA, 1286 bp, Homo sapiens
cgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccagtacaacagcagcgaagatgagaccctcatctaccggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctcaaaaaaaaaaaaaaaaaaaaaa

SEQ ID NO: 358 - DNA, 5828 bp, Homo sapiens
cggcggcgcggtcggagggggccggcgcgcagagccagacgccgccgcttgttttggttggggctctcggcaactctccgaggaggaggaggaggagggaggaggggagaagtaactgcagcggcagcgccctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttaaaaaaaaaaaaaaaaaaaaaaaaaaaaa

SEQ ID NO: 359 - DNA, 433 bp, Homo sapiens
ttttaaaacaaacaaaacttttatggtccaaaacagtttttctcaagaatctgctctatgcaaacaataacaactttttacaaagcattttcacagaaaaggagacaagtccttccccagcgtgggaattgttcctctcgcacctcgttttcgggggaagagggggcgctattcactagtgcgggatggaaggcgcactgggtccctcagttgttcggcagctccaaaagccccagcttcccttcatacctcaacttgccatctccctaagacctaagctcccctgacctcacctgggtggaggagaaagcacttccaatcctctctgactcaagatcctcctagctggagggcatggcagagggcatgatccaggcctatctcacccctcccctggaaaacagaacctctgaccccaaacctaatcccctcg

SEQ ID NO: 360 - DNA, 1830 bp, Homo sapiens
cctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttc

SEQ ID NO: 361 - DNA, 1167 bp, Homo sapiens
gaattcggcacgaaggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtccatgcgacctccctgaggaggaagacaatgtgtggcaccctggactacctgcccccagagatgattgaggggcgcatcgacaatgagaaggtggatctgtggtgcattggagtgctttgctatgagctgctggtggggaacccatttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatcc

SEQ ID NO: 362 - DNA, 541 bp, Homo sapiens
tttttttttgtcaacacatgcattttgctttattcatttgctttatcttatggatctctccattttgtagagtattccattgtatagctgtacagtaatttagataaacttttgtattgatagccttttcttttggagatgggggtctcactctgtcactcaggctggagtgcagtggcacaatcacagctcactgcagcctcaagctcctgggctcatgccatcctcctgcctcagcccctgagtagctgggacaacaggtgcatgccaccatgccttgccgagtttttgtatagatggggtttcaccatgttgcccaggctggtcttgaactctggactggtctggacttgagattcagaccagatctgtaagccactgcacccggccttgatagccatttgttttcatacacagcagcaattagtagccatttaagatatctgtgcgccagcctacaagaaatacaaatgtacagggtaaaatcctagctggatcaaatatgagctttgtaaatttttaaaaacttttttattgagtt

SEQ ID NO: 363 - DNA, 716 bp, Homo sapiens
gccccttcccgtgatcttcgtggcttcccgcccagacgtgtgaccaagatagcaaggagcagtctttaaggcgacacggcagagaggcagaaaaagatgggccttaccggttagttaagaaaaaaagaggacctgtgcctgtccctctagctttgaactacaaagtggaggggaagttgtctggattttcctgtagaactgagggcaggacaggaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagtgggtttgcacaacatttgcatctacttgggacaaagcaagaacaataaggacaaaaaaaaaaaaaaaaaaaaaaaaaaaaaatttggggggggacaggggaccattcaagaggctttgagagaacaactggtggggaccgcaggcccagaaggataagagcaacacgtggccacagagggaccacgggaaaacacgggcacagacacagggcggggatatcaacacaataaaaaagccgggcggaaaacgagccttgtgaaaactcaaagggggatcagagaggaaaaggggaatataacagggggatccaaggaagcgaataaaattgcccggcggg

SEQ ID NO: 364 - DNA, 568 bp, Homo sapiens
aaggaataaggtgaatttttattaagtgaaaaaaatcaataacaatataggaatgatcacatctatacaaatacattgctacatttctacatataaaatgtataggaaaaagtctgaaagaatgcacaccaaattattctgtttttaggaaaagcagtaggattggtcagggcatggaatgtcggctaagtgaagtgagatttaaaatttttattctacatgattttctagtgttgggaatttttgacagtgagcatacatgcacttattacttgcataattctgaaaactattttaaaaacaacagagaatatatgaaagtctattggtgtatacagcattaatagtagtgaaagtttaacagaaaagatctgaaaatctcccaaagttatatagaaacagatctagctgacacactgtgtacctagaaatgattttggatctcttcacagagacccctatcccaccaacctccaatcctcccaccatacattgatccctttctatctgcttggatcattagctgtaaatttaacttcgaaaaacaaagtacgtttaatcattgtac

SEQ ID NO: 365 - DNA, 676 bp, Homo sapiens
ttgatctgagcctccctttctcacccacccaaagcagcgaggagagaatatggaaacgtatgacaggatgtatatagcaatacaaacatattgaatgaataaataaagacataaatatgtgggagagtggaccacgcaagcacaaaaagaggagagaaggcagcaagaattatgactaattcaaaactgggttcctgagatagttaaataaatcctgcaccaaatccccaggggggagaaattaacaaacaaaagacagccccacacggaccagtgtgcagaaggctccagggaaccgccagattattggttaatccaattctgtgcacctgaggtccataaataaaagaataagtattgaaatgaaagaatgacagaaagaatgaatggaccacatgaacgactgaattagaaatggaaatgcctggcacagccaggaaggagctgcccatgggattgtcattcatctcactctggggcaccctgaggtccataagcgtgaaaagaggcaggaagagaaggtgtcagggagtcaaagatagagctaaggaaaggcaaaaatgaactaaatgaaagcgaagggaaataagaaaaccaataaaaagagacgatacgtggtgttctgtaagagtaggatctgtaggttacgcctaagatgtcagtatcctgaagagga

SEQ ID NO: 366 - DNA, 1530 bp, Homo sapiens
aatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtgggccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtaaaaaaaaaaaaaaaaaa

SEQ ID NO: 367 - DNA, 1767 bp, Homo sapiens
ctaaagcgagaactgtcgcccttcacgatgtggctccgtgcctttatcctggccactctctctgcttccgcggcttggggggcacatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggagg

SEQ ID NO: 368 - DNA, 1848 bp, Homo sapiens
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtggggcccttaggtccaatgggatttctgaaaagtgccttaagttttgctgaagatgaagaatggaagagaatacgaacattgctatctccagctttcaccagtgtaaaattcaaggaagtaagaaaataaggtgatttataattagaaacttaaaggatgaatctggagacaggtagtaagtatcatcatagttcctttctaatgggtagtccactgagtttgagctttctaaaaagggtcttttcagctgggcacagtggctcatgcctgtaatcccagcactttgggaggccgaggtgggtggatcacctgaggttaggagattgagaccagcctggccaacatggtgaaaccccaactctactaaaaatacaaaaattagctgggcatggtggcggatgcctataatcctagctgctcagaaggctaaggcagaagaattgtttgaatctagaggcggaggttgcaatgagccaagattgcgccgttgcactccagcctgggcaacaagagcgaaactctgtctcaaaaaaaaggggcagggggcggtcttttctatttatgtcctagaggacatggtgagtcattacaaaatatcatttactggtccatgctgggcaaagccatgtccttctgagactcgagtctgcgtagttaactatgggtggtgttgtgttttagatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaactcttcaaccagaaaaacctattgttctaaaagtgcacttaagagatgggattacaagtggaccctga

SEQ ID NO: 369 - DNA, 494 bp, Homo sapiens
  modified_base (148)..(148): a, c, g, t, unknown, or other
  modified_base (150)..(150): a, c, g, t, unknown, or other
  modified_base (171)..(172): a, c, g, t, unknown, or other
  modified_base (189)..(190): a, c, g, t, unknown, or other
  modified_base (234)..(234): a, c, g, t, unknown, or other
  modified_base (250)..(250): a, c, g, t, unknown, or other
  modified_base (260)..(260): a, c, g, t, unknown, or other
  modified_base (275)..(275): a, c, g, t, unknown, or other
  modified_base (281)..(281): a, c, g, t, unknown, or other
  modified_base (287)..(287): a, c, g, t, unknown, or other
  modified_base (321)..(321): a, c, g, t, unknown, or other
  modified_base (331)..(331): a, c, g, t, unknown, or other
  modified_base (362)..(362): a, c, g, t, unknown, or other
  modified_base (386)..(386): a, c, g, t, unknown, or other
  modified_base (399)..(399): a, c, g, t, unknown, or other
  modified_base (422)..(422): a, c, g, t, unknown, or other
  modified_base (437)..(437): a, c, g, t, unknown, or other
  modified_base (443)..(443): a, c, g, t, unknown, or other
  modified_base (460)..(460): a, c, g, t, unknown, or other
aatatgtttcgacagcaacaaaagattcttcaacaatctagaattgttcagagccagagattgaaaacaattaaacagttatatgagcagttcataaaggtttgttgtatgtggtaacacaatacatcgttataaaacataatatatntntggaagtagaagataattctnnctaagtttatgggaaannacattttagactttaactactttcccattttgaattcattgttnctgatttaagtgatanatatatttcnccttgagggattcanatgggntttgcntggggattattcaagacagggaaatgggtaaatnggggaatttnacttaggaaatatacttatccatggcataanacccctactttaataaccacttcnggtcctaggttcnccggtttaaggtggaaattgggnccccataataccccnttttcnggggtggattttccccngttttttccaacccccggggttggtcaataggga

SEQ ID NO: 370 - DNA, 590 bp, Homo sapiens
  modified_base (576)..(576): a, c, g, t, unknown, or other
cacaacaccgagcttgtttctccacccacatagactgtatttgtcactattatacacaatatggtgccatcatgcatattttgtacatttgatcagccaatatttatataaaactttcataaacactttcaaacagttttaccccacagggtgggcagaggtgcttgtcaatataataaaactgaacaacagtggtagaaaaaggtacacttgtacttatcttcaagtttaagatgtaaaattttttctgttcaatggccactacctcatattatttttaggatctgggatcggacttagcaacacattatgactttcaagaagttgagctcactgttttgtggcgttctttgcagaacaccatgaacttccgggtgccccatgtgctgacaagtgtcagaacagctggtgtccagctgacgtgaggctggacttgtgtgataggcacgttgtggccatagctccccactctgtgaaatgatgagatcgacatgcctccatccatcagtaggatccccagcatggagaatttacaccgtcacccttcaaagaaaggagccaagtcctgggcacctnctctcaccttgact

SEQ ID NO: 371 - DNA, 256 bp, Homo sapiens
  modified_base (28)..(28): a, c, g, t, unknown, or other
  modified_base (122)..(122): a, c, g, t, unknown, or other
  modified_base (130)..(130): a, c, g, t, unknown, or other
  modified_base (133)..(133): a, c, g, t, unknown, or other
  modified_base (188)..(188): a, c, g, t, unknown, or other
cagaaagaaacaaggtttatttgatgantataaataaggcgatcagcacaaagtacttctcatacacatgacaacaaatttatgaactgtacataccttgtacattgttctactagacacgnggttacantgnctggctaatacatgcccactggtagtttccagggttccttagttttatttatttntttttcatatcgatgtccataatcacatggtcaatatcacaacccacatgccactcacttgaagaaat

SEQ ID NO: 372 - DNA, 4156 bp, Homo sapiens
gacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaagggccccagaaatcacaggtgggcacgtcgctcgtaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacgagcatacagcacacacacaaacgcacagcacacacagcacacagatgagcacacagcacacacacaaacgcacagcacacacacgcacacacatgcacacacagcacacaaacgcacggcacacacacgcacacacagtgcacacacagcacacacgcaaacgcacacgcacacacaaacgcacagcacacacgcacacacagcacacacacgagcacacagcacacaaacgcacagcacacgcacacacatgcacacacagcacactagcacacagcacacacacaaagacacagcacacacatgcacacacagcacacacacgcgaacacagcacacacgaacacagcacacacagcacacacacaaacacagcacacacatgcacacagcacatgcacacacagcacacacatgaacacagcacacagcacacacatgcacacagcacacacgcatgcacagcacacatgaacacagcacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattagatgaaaacaataagcatatctaagcaactacgatatctgtatggatcaggccaaagtcccgctaagattctccaatgttttcatggtctgagcccccctcctgttcccatctccactgcccctcggccctgtctgtgccctgcctctcagaggagggggctcagatggtgcggcctgagtgtgcggccggcggcatttgggatacacccgtaggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggccggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcatggccatgagcccccttggagaagtcagaggggagtggagaaggcatgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcagctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaaagtcatgatcttctgaggtgttccactctctgacttgggtactggactgccggagggagggaaggggctgagcacctggaagcaggcagagggggatagaagagggaaggggaaggaaggcct

SEQ ID NO: 373 - DNA, 3485 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatgacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 374 - DNA, 487 bp, Homo sapiens
  modified_base (433)..(433): a, c, g, t, unknown, or other
  modified_base (471)..(471): a, c, g, t, unknown, or other
aggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccaccctacttcccaaaagcctgtagaagcccccacttagaaaaaaagggcagacatacacatacacagaaacacatatctatctggcagctcctccatgtgaagcccctggaaacatacacacccngggacttttcctctccttatggcacagatgggacaggntggcctttcccctgtt

SEQ ID NO: 375 - DNA, 539 bp, Homo sapiens
  modified_base (11)..(11): a, c, g, t, unknown, or other
  modified_base (470)..(470): a, c, g, t, unknown, or other
aacttttagangagatggggtctcactgtgttgcccagactggtctccaagtcctgggctcaagtgatcctcccgcctcggcctcccaaagtgctgggatgacaggcatgagcaccgcgctggcctgatttgaatgttaatgtgtcacacatgcatcttccctggaagatcttggcaaaatgcttgtctctctggtcttttaaacatgacttggtgctgaaagacacactgctgggacccaagttccctcccacatggacgggatggaggctggagccaaggtttcagggaaacgtatgtggcctgtgcccctggggtgtgatcatggggcacacacatttatctgggcagggcaaccttggcttcttgagggggtcatggggcacagagggagggacccatcttggttgacacttgagggacccagtgtttgccccaccagccaggggaggattaagggatgaggattnagtttttgcccacacccccttccagattgagcttcaagaaaggaggcccagccttagcccctttaactt

SEQ ID NO: 376 - DNA, 484 bp, Homo sapiens
aattcttatagatgtttattagttgttagatttaaaaaaaaaacagggcttataattaaagcaattgactaatgatctcacagcctcaaggttgtatgcaaacctagattagaaatactttgtctctaaaaataacaaaatgaccataacattttttttcttacaagtttgaagtggtcaattatgggtaacacatacattcctaaggaaatctgaaatggtcttgaagaataagtttctttgaaatggtaagtaacacaaaaagtgtacttctttttttggaaaatgattcacaaataacccctttaaaccaacaattggtgatttatattctggtcaggattttggagtctgggcaatgccattacttagctgttttgactatgagaacttttacaaatttattctgacttctatgatctttaatctcttttctacacctgaaaaataataaagattgtaaactagatgtcctcaaagattc

SEQ ID NO: 377 - DNA, 2442 bp, Homo sapiens
gcgggattccgggccgggccggcctgggctgcaatcaatgcggctttgtctgggacgcccacatcccagaggccattcccgggtcggcaaatcggagcgcggcggggcgcgcgggggtgagataagcggccatgtgatcccacctgggctggaaggggaggggcgccaggtgaggcggcggccggtggggcgcgggcggccacgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctggcccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttcccttgttggctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccaacaagtgcctctttgtctatgatgtcccccttctctgaggcctggacccacccatctttgtccctgggggctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctc

SEQ ID NO: 378 - DNA, 3044 bp, Homo sapiens
gtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggagtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactggcaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccagattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttacctcatacagtacgtgtcctgtttttaaaatatacaattattcttaaaaataaattaaaatcgtatacttacatttcaaaaaaaaaaaaaaaaa

SEQ ID NO: 379 - DNA, 570 bp, Homo sapiens
tttttcaatatgtgtggtactttattttttatgttctttttttaaatctggggtattagtctgtgctttgggagaaatgcactagctctgcaattcccagctgggcaagtgtgtctctagtatctccacgcaactgatacactggtcccttccccatgtcctctccaggcactgtgggtcttgggaagtggttcttgtcagcccgagggacactgggttctccactgtccttcacaggaaattctagcttcctcagcctttgtgccaccacacttatagcttcctgtgcaaagtatttgacatccatgtcttcatcttgacctaacttctgtagtactggcttcacttctccctgtaaagcattggtatctagaattggtccaatcttttgtagagatttggccacattgaagcgaacatttgctacttggtctcctgccatttttaatacgatgggcagcatttgcttagtagttatttcctgaccacaggcctcagacagtgcattaatgcagaataaagtggtcattctatgcaagtaattaggatgatttgccattactaacactt

SEQ ID NO: 380 - DNA, 1702 bp, Homo sapiens
ggagtcgaccgctcgggcagcgcaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctccggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacacttcctcccccgcttcctcctagccctgtgggcaggggttggaaacttagcactttatatttatacagaacattcaggatttgtcaataaaatattgttatatttaaaaaaaaaaaaaaaaaaaaaaaaaaa

SEQ ID NO: 381 - DNA, 316 bp, Homo sapiens
cctcttctcttctcgcttgggaacgccggtctcacctcggcttgcaatggaccccaactgctcctgcgccgctggaggctcctacgcctgcgccggctcctgcaagtgcaaaaagtgcaaatgcacctcctgcaagaagagctgctgctcctgttgccccctgggctgtgccaagtgtgcccagggctgcatccgcaaaggggcttcggaaaagtgcagctgctgtgcctgatgtcgggactgccctgctctcggatgaaaacagaatgacacgtaaagtccgggatttttttttctacaactccgactcatttgc

SEQ ID NO: 382 - DNA, 2732 bp, Homo sapiens
gtctttatttcagtcccggatccgcgggcgcaggcccagctcaggcccccagggatggacgtcgtggaccctgacattttcaatagagacccccgggaccactatgacctgctacagcggctgggtggcggcacgtatggggaagtctttaaggctcgagacaaggtgtcaggggacctggtggcactgaagatggtgaagatggagcctgatgatgatgtctccacccttcagaaggaaatcctcatattgaaaacttgccggcacgccaacatcgtggcctaccatgggagttatctctggttgcagaaactctggatctgcatggaattctgtggggctggttctctccaggacatctaccaagtgacaggctccctgtcagagctccagattagctatgtctgccgggaagtgctccagggactggcctatttgcactcacagaagaagatacacagggacatcaagggagctaacatcctcatcaatgatgctggggaggtcagattggctgactttggcatctcggcccagattggggctacactggccagacgcctctctttcattgggacaccctactggatggctccggaagtggcagctgtggccctgaagggaggatacaatgagctgtgtgacatctggtccctgggcatcacggccatcgaactggccgagctacagccaccgctctttgatgtgcaccctctcagagttctcttcctcatgaccaagagtggctaccagcctccccgactgaaggaaaaaggcaaatggtcggctgccttccacaacttcatcaaagtcactctgactaagagtcccaagaaacgacccagcgccaccaagatgctcagtcatcaactggtatcccagcctgggctgaatcgaggcctgatcctggatcttcttgacaaactgaagaatcccgggaaaggaccctccattggggacattgaggatgaggagcccgagctaccccctgctatccctcggcggatcagatccacccaccgctccagctctctggggatcccagatgcagactgctgtcggcggcacatggagttcaggaagctccgaggaatggagaccagacccccagccaacaccgctcgcctacagcctcctcgagacctcaggagcagcagccccaggaagcaactgtcagagtcgtctgacgatgactatgacgacgtggacatccccacccctgcagaggacacacctcctccacttccccccaagcccaagttccgttctccatcagacgagggtcctgggagcatgggggatgatgggcagctgagcccgggggtgctggtccggtgtgccagtgggcccccaccaaacagcccccgtcctgggcctcccccatccaccagcagcccccacctcaccgcccattcagaaccctcactctggaacccaccctcccgggagcttgacaagcccccacttctgccccccaagaaggaaaagatgaagagaaagggatgtgcccttctcgtaaagttgttcaatggctgccccctccggatccacagcacggccgcctggacacatccctccaccaaggaccagcacctgctcctgggggcagaggaaggcatcttcatcctgaaccggaatgaccaggaggccacgctggaaatgctctttcctagccggactacgtgggtgtactccatcaacaacgttctcatgtctctctcaggaaagaccccccacctgtattctcatagcatccttggcctgctggaacggaaagagaccagagcaggaaaccccatcgctcacattagcccccaccgcctactggcaaggaagaacatggtttccaccaagatccaggacaccaaaggctgccgggcgtgctgtgtggcggagggtgcgagctctgggggcccgttcctgtgcggtgcattggagacgtccgttgtcctgcttcagtggtaccagcccatgaacaaattcctgcttgtccggcaggtgctgttcccactgccgacgcctctgtccgtgttcgcgctgctgaccgggccaggctctgagctgcccgctgtgtgcatcggcgtgagccccgggcggccggggaagtcggtgctcttccacacggtgcgctttggcgcgctctcttgctggctgggcgagatgagcaccgagcacaggggacccgtgcaggtgacccaggtagaggaagatatggtgatggtgttgatggatggctctgtgaagctggtgaccccggaggggtccccagtccggggacttcgcacacctgagatccccatgaccgaagcggtggaggccgtggctatggttggaggtcagcttcaggccttctggaagcatggagtgcaggtgtgggctctaggctcggatcagctgctacaggagctgagagaccctaccctcactttccgtctgcttggctcccccaggctggagtgcagtggcacgatctcgcctcactgcaacctcctcctcccaggttcaagcaattctcctgcctcagcctcccgagtagctgggattacaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgcaaaaaaa

SEQ ID NO: 383 - DNA, 2387 bp, Homo sapiens
gacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgcgggaattc

SEQ ID NO: 384 - DNA, 398 bp, Homo sapiens
atcactgttttaattatggcatttccccactgggaacattccttacaatcaaaagaagtgttatacatacttaacacttctgttcttacaatatattcagcagtatcagttacaaccatttgggtatgtgaactgttcgctaaataaaacatcatacagtaagtttcaagggccacaatggtatggcctcttctaccacagacaaatagattaattttggcaggcgttggaaatctggtaggtcatggtagcttcatcagaaacatgcagtcctttccttcgttagaggcatcagttcttagactgctggagggcttcagtgtagtaaatctatatacatagtccccaatttttttttttttgattttgagatggagtctcgctctgttgcccaggct

SEQ ID NO: 385 - DNA, 2578 bp, Homo sapiens
tctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaaacagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgttttt

SEQ ID NO: 386 - DNA, 535 bp, Homo sapiens
  modified_base (525)..(525): a, c, g, t, unknown, or other
ttttttttgtttttgatatgcagatttaaaaatactagggcgattttaatagatgataaatctccagtatcacaaggattagggaaagcaaaagacctgaaaagtaataccagttctcagttctctaactctcaaaaggcattccacaggtaaattcggtgaaagggccggcaattgttcaaatgtttaaataagaagaagttgtagttctcacatttccagttctcttacaggtgtgtgtatttggaaagataatactctctaatgttggtcttttccattgttcaggtttatcctgttgttaagtaataagcagcaatccaaatacaaacatattgtacaacagctattaatgaacatcacctgagttcagtgtgcctgacagctgacacttagttaatttctccatgaaacaagaacagtgaaacttccacagatgagaaaacagaatcatcagtggcactgggatgtaaacccaagtacctgctttgcatttcatttgctctgtttttcagaactacactntacgacatga

SEQ ID NO: 387 - DNA, 473 bp, Homo sapiens
aaacatttatttgttaaagtgatatagattattcaagattctacagtctgttaaatcatggatggcaatgtaagatggattgatacagaacttgatgccaatgtaggctttttttcttttttaaaaaaaaaatacttgtaggccagaagaaaaaaaaatttggttttaaaagaggatgaaccatggtctaatggagccagttccgccgtcatcagagactttcaccttggctcctgtagacaatttcttctacgacaccagttcaacaattagcctttgtgaattgaaacatttttgaattttatccagtaaaaatatcagtggcaaattttttcaggagagagaggagaagtggtgctcttcagattaactccagcctctgtgtttcctggacaatctggtcaacattagtcagcaaagcatttggctttatatgtgctcttttagacgtgggcccctctgtgacagaatcg

SEQ ID NO: 388 - DNA, 923 bp, Homo sapiens
cggacgcgtgggcggacgcgtgggcgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaaaaaaaaaaaaaaaaaaaaa

SEQ ID NO: 389 - DNA, 512 bp, Homo sapiens
  modified_base (505)..(505): a, c, g, t, unknown, or other
aaaaattatatttaatacaagtgaatagattagaagatctgaaatgttataaagcaatatacacaacgaataaataatttgcacaggagagtcatgtctacattacataacactgtctagtatgggaatacttaaagtaaatccagtgataatggagaaagtccataaaaatgctaacctgtcttcccttgtatgaaattgttcaagtataaaaatccaattcagtgtaaaataggattcaatttagtttaagaataaaaattgcaagtattgcagtttcagaagaaaaatgtaaagcagcatttaaaaactacataatagtgttaaactaatgaattaccaataaatgaaatctacacaggcaaaatcagaggaggaagcatgaaactagcaatatatcgtttaaaaaaaaatctaaaaactaaactaaaatgtgttaatgtaagagtactctcttatacagtgcacatatgaatttaaataaatccaagtcaacatctttagntgaatag

SEQ ID NO: 390 - DNA, 2478 bp, Homo sapiens
cacctttccgcgggccgcggggatggcggcgcagggcgtagggcctgggccggggtcggcggcgcccccggggctggaggcggcccggcagaagctggcgctgcggcggaagaaggtgctgagcaccgaaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcaaactcgagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagagggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacacctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaaaaaaaaaaa

SEQ ID NO: 391 - DNA, 2356 bp, Homo sapiens
tccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaatgccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattgttatggcatgcatggagtatgaaatgggaaagaaaaagtgtgagcgctactgggctgagccaggagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgttgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcttttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtacggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcaggtaaaaatttctcttggctttagatgacatttagccctaagattggaagaatggttcgttaagtttagagtaattcacttcaggaagttacttggttcccataatagcttccagtattcattgatttatttctggctttcccagactagaaattttgtaaagagtcatgggggaagctagggctaaccagaaaataaaataaaaataatgggataaaaaatcggaactactgttttccccctagtcggagcacatccgg

SEQ ID NO: 392 - DNA, 1497 bp, Homo sapiens
atgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcataggatttttcaaatatatttattattaataaaataataaaagaattcatgggctacaactagcacagggaatttagaggttgtagcatcttctgctggagtaatactcaggctattctaataacagatgattccttcaacagactgctatatattcaccatgtaaactgcagccacctttagtgatacttttgaaaaaaaaaaataaagggatatggctgttgtagaaagatagcgtatttgcatttacaataacagtagcatgttgtcagtggccaaggctacacagaaggctccctgctgcccggagcaggtacatccaccagagcaaagggaaccacttttattttgcatgagtttggtaactgattactctcccctcaaagaaaagacattcaggtgtttctcaacgacatcttctgtccagcaagctcggtttgaatacgtcacttaccagtgccattgcaggacccaaattcacagttcataaaagatgtgaccactacatgtaaaaatagcattctacttgatcttacagtatgtatgtatgtatgtatggagacatatgtgtgtgtgtggatgtctacatggttaatggaaagcactgtgctctgaagtggatcagtctcaagtgtctggtaacagcagcagtgcttagaaaattcttttgttgaaaagagttactgttattatcagaatttgccaacctaaagaatgaatttttaaattcataacttggtcatgttcacaacaaaactgtcaaataagcatatttccatttttattactgaaagaaatatgggcattttcattctttaaagaaataaagcacaagaattttatctc

SEQ ID NO: 393 - DNA, 958 bp, Homo sapiens
tctaaagctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtracaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcagggagataccatg

SEQ ID NO: 394 - DNA, 5285 bp, Homo sapiens
gatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 395 - DNA, 867 bp, Homo sapiens
cgtttcagcgtggcggcgctggtgctggcgttggccctggaggacggccccgagtgatggctggcgcctgcctcccgggtgtctcccgggtacagatggagtcgtcccgcggccgccggcggcaaggtcggcagctgcgaggccaagagagaccccaggacacacacagctgcctcccggtgcgagaagaagaccccggcttgagagtgagatggcgtttaatgattgcttcagtttgaactaccctggcaacccctgcccaggggacttgatcgaagtgttccgtcctggctatcagcactgggccctgtacttgggtgatggttacgttatcaacatagcacctgtagatggcattcctgcgtcctttacaagcgccaagtctgtattcagcagtaaggccctggtgaaaatgcagctcttgaaggatgttgtgggaaatgacacatacagaataaacaataaatacgatgaaacgtacccccctctccctgtggaagaaatcataaagcggtcagagtttgtaattggacaggaggtggcctataacttacttgtcaacaactgtgaacattttgtgacattgcttcgctatggagaaggagtttcagagcaggccaaccgagcgataagtaccgttgagtttgtgacagctgctgttggtgtcttctcattcctgggcttgtttccaaaaggacaaagagcaaaatactattaacaatttaccaaagagatattgatattgaaggaatttgggaggaggaaaagaaacctggggtgaatacttattttcagtgcatcattactgttccagattcctatgatggatggcagactctttaataaattgcttactgatattatctt

SEQ ID NO: 396 - DNA, 2576 bp, Homo sapiens
gaattccgggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaattttggaggccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgtttgttgattacagatacagccaggctgatgccctgaagtatgtcggcatcgaaagagaaatggaaatcccttgacatctgctacctcctccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgaaaaaaaaaaaaaaaaaa

SEQ ID NO: 397 - DNA, 23379 bp, Homo sapiens
acacaaatgctcccacaggggactctcctacggatcacatgttaaagactggagggactgtgggtccctgagtcaccccttagaggccggccgcctgatcagtaagagctgtgctggcctttgcatcactggaaagcaaactcactctgctgatccactgagatttggggctttgttacactagttagcttttcttattctcactaatatacaaatcagcactttgaagtgcagtgcacatgtaaccaaacccttaagtacatggcactggctcagcgtgtggccaggtggcgagcagtgataagacaggtgcagctggcaggacaactgaggtccctgccaggcggagcaaaacatctggtaaggccgtttcactcgataactcggaaaacaaactccatgtctgctgactttttgacttgaggggaataaacaacaacaacaacaacaaatatgtgttgattgttactggctgcttttggcgaggcatcacgagaaaaagtttacttcaagaaagaattagccagtttacaagcagaagggaaaaagatggaaagatgttaaccagggccttgcaattctggaaaagccaactgcttctagtctccaaccagtaagaggtgcaggtgagcaacaaaggccccatgagacttagttgaacacagtgactgggcctcatggtgaccatccaatgaagggtgtggtcttcccactggagcatggaaactgcaaagccaccagcttgagggaggggcacgtggttaaggaagcaaagaaaaagctgacatgagaactgtttccaggaacaaaccatgaatgtagtcactgaccctggacctgcctggaaataaataaagatgtagtaaatttaagaaaccattagcaaagccttaaaaaaaaaaaaaaaaaaaaaaaaaaacggtggcaattgaggaagtcttaaatccaccttcaggcaggaaaatggttgtgaaagctgtgtccagcgagggctttacaagctcagatgtgggcccaagagcagaactgggcctgagcgaggactccccccagcccaggacagggcccagcaggattgcaaaaacaccgcagagcagcaattgctgcatctgcacccgctccttcctgggtaggagggcctaggagggtgtcctgcctgttctcatcactacctgctgggtgggaggtggattaagctgtcttgttaattcaggattgtggacttcaaagagccacctgagggaggctgcatcacctggaggtctgggcggggtgtgacctcgtattgtccccctaggagagggtgcctgtgacccatgtaggagaggaagcacaaaactggttttggtgatcagaatagcaaactgggccagatgcttaccacacatttcctcttcctgagtccacagcttcgactgcatggcctgggcccgtggcatctacccagatgccttgggaccagccctcaccaatgatgtgtcatttcaaggccattcacagtaacagtgtctcctccactgtctccatcaaccttgaaggcttatggtgaagatggtaatacaacaggattgaaggagactgggtccctgaatgactttgtggaacagagcactataggccaaaggtagtagaattaggtatcttgttttatgctgcttaagtgaattaattaattctctagatttattcacctagttattcaacaaatttttattgagcacatcagggctagggcattgtgtcaggatcagagattttgcaatgaacaaaacagaaaactccatgtcctccaggggagttgataataaaatgtcagataagctctgtgaagaaaggtaaaagtagggttaggggtagaaagtgctggggggattgctacttaacatagtgtggccaggggaagccattctgctaaggtgacagctgagcagaacgatgagtggagggggcaggaaggaatgtggaggtctgggagaagagcattccaaacagggatggcaggtgcagaggccctgagggggcagcatgcctggtaggcctgctggatatttctgagaatgaaaaagtccattcccagttgtttgcgtggagaacctaacccagttataaacacaaagtacttgagagctggtttaatatacagccagctttccagcagtgcaactactgtgtacatcaagggaaaactgaacttcgttttccttaaaacttatcatcagctggtcatcattttgacaaattctgtcaacaacagcagtgtcattcctggcatctgtatgggtcacgtctgaacagacacacgccctgcagccctgcaggtaccagctgtataacaagaactcccttccaccctgtgtcctggaaacaagaaagccatagaccggaagatcccgatggctatctcaaatgtgctggatggagttgccagggcccactggcatgccctgtaagcctttccttccacgtttggttcctgccccttgaagactccatttctgagtttgtgtgtgttttactttctagtgtgtgtcctcatcttaatttttctctctctcttctgccttgaactgaaggttcgcttgggtgtggagagacaggcccccagcagagcagcttcccgagacatcctccgatccagggcttcccagcagcccggcaaggcagggctgtgcctttctgcttcagctcacaagcatgccaggctcactggcaagctgctgtctggttgagagactgctcctaaagccctgcacagcccctgtcctcctggccctctggaaattccaccaacccgtgtccacatttcatgcaaaaatgagctggttctgtgagcatggcccggcctgactcgcttagtgggcggtaagtggtttccacttcaaccttgcacctaatcaccgggctccacaccaggatggacattcatgagccgtgaagtttccagtaataaatccacagatgcttccagcacctgccttttcgcatcacctccactcccagccacctgccaggcaacaggtaacagagacccagtcacaggagggcagtgtgggggcaggactgcagtctcccaaagcccatgcacaaaaccgacagcgccctggcaggacaaggaggctgacattcagatgtggaggaacaacgcatgacccattcctggtcatgggggccacagctggactcagccttgaggcttggccagacttaacaccgtgtataaaccaggacctttttaggtagagtaatggaaaccaaactctaatgatcttagacagtgctattagtctcctggagctgccagaacaaattaccgcaacttcagtgtcttgaaacaagagaaactgattctcacagttctggagaccagaagtctgaaatgcaggtgttgccagggctgtagtctctggagactctaggggaatctgtgcctacctcctccagcttccagtggctcctgacattccttggcttgtggctgcatcaccccaatccctatctctgtcttcccctggtcttttgctcaaaatgtctgtgtttagtttccctgtagacacctctgcatcactctcatgagatgcagaggtgcgacatacaggtgttgagagcccacttagataatccaggataagctcctctcaagatctgtaacttggctgggtgcagtgtctcacgcctgtaatcccagcactttgggaggccaaggcgggaggttcacttgaggtcaggagttggagaacagcctgggcaccatggggagaccctgtctctactaaaaatagccaggcgtggtggcacacacctgtggtcccagctactcaggaggctgaggtaggaggattgcttgagcctgggagtttgaggctgcagtgggctatgactgcaccactgaattccagcttgggtgacagagtgagactgtcaaaaaaaaaaaaaaaaacataaaacataacttaaatcacatctcttgccacagaaagtaatactcttttgcctacatataaggtaatatttacaggatccaggggttaggatgtggacatatctttgggaccactgacagccatgaagcaatctcataattttcaaataggttctgtcctttttatctttccagtcttttggaaagcatatgcctatattttcaatccacaattctatttttatttgaggtcatttcatttctggtttttattttttattgagacagggtctcactctgtcacaggctggaatacactagcacaatcatggctcactgcagccaacttctgggctgaagtgatcctccagcctcagcctcctgagtagctggaactacagacacacatcaccatgcctggctgattcattttttaattttttctagagacaggctctatgttgcccaggctggtctcaaactcctggccccatgcaaacctcccgcttcggcctcccaatgtgctgggattataggagtaagccgccttacccagcctccagttttattgtgttttgttttgttttgtttgagacagagtcacgctctgtcaccaggctggagtgcagtggcacgatctcggctcactgcaacctctgccttgcgggttcaagcgattctcctgcctcagcctcccgagtagctcggattataggcatgcaccaccacgcctggctaaatttttgtatttttagtagagacggggtttcaccatgttggtgaacacaaagtatttgagagctggtttaatatacagccagctttccagaaatgcaactactgtgttcatcaagggaaaactgaacttcgttttccttaaaacttatcaccagctggtcatcattttgacaaattctgtcaacaacagccatgtcattcctggcatctgtattggtcacatctgaacgacacacgccctgcatgcagccctgcaggtactggctgtataacacgcctggcaagaattcccttccaccctgtgtcccggaaacaagaaagtgattgtgatccgctcacctcagcctcccaaagtgctgggattacaggcgtgagccactgcactcggcttcctccagttttttttttttttcaatgcttatattttactctaattaactgagtcaaaaatggagaatagttgaatacactttcatgtaaggcgaatcatttagccgatacttaactctgcatttgggctaccatgccgctgtggttagcggggcaaggtgatgagccctgtctcaacacacacaccccgcctctccccagcccacttacacgtgtccattcccacgcaggtgtgggggccttagaggattccctcttcttcgtaaagtgagaatgggctagactcggcttcactgcccaacaactcctttttttcctttgggaaactgtccttcccattccatataaccttcatgggctgagatcactcaccgagctacaggaagaggcccattactatggccccatcagggttctgcctgggacagtccataaatgctggaagagagaggtgcctttccctactgaggctgctaaaaggagacactgcaaactggggctgctggtggcaatcttacactctcagtgaaagcctgcctggctgcaggggaaaccaatgcacagaccagcaggggcaacatcatttgaacccctggagacagctgtgcctgaagcccacatggctcaggcacatgctcaagccactctgatttgcttgttacagtcaagagagtccttggccgggcacagtggctcatgcctgtaatcccagcactttgggaggccgaggcaggcggatcacctgaggtcaggagttcaagaccagcctgaccaacatggtgaaaccccgtttctactaaaaatacaaaaattagccgggcatggtggcatgtccctgtaatcccagttgttagggaggctgaggtgggagaatcgcttgaacctgggaggtggaggttgcagtgagccaagattgcaccactgcactccaggctagctaacaaagcgaggctctgactcaaaaaaagggagtcctgactgaagctgagaggctggtggacagctgtcagcaagcagtgtttgtgggtctgatgtgagctgcgaagtccacacctgatttcagagctggtggctctttttccaatcaggacagctccaggcctgagttttggtgtggtctgtacctaaccgctgtgtcttaggtcaggatctctagaagccaagcccaagacaggagttctcaaatgccatgatttactgagggaatgcctttgggggaacctgccagtgaggagagctggaggaggcgggcaggggcgggagctgagccaggtgggggtccctgctggagtctagcctcagcttgaccccacaggggctctggagcaggaacagcacactgcattgtcccttgaggcagtcactggctgcagttgcctctgggagcagagtaaaagtggacaggcatttctgggagtacaattccctagagaaggggacagctctgagctgtgttaccagccaccatttccaggggctgggggatgcgctgcactggcccagagaggtctctgagcaaggcccccacaacctccacttcaacctcctgccaaacctcaagcagattgagaaggagccgctagagacacaggaaccctttcctcatcagaagtctccaagctttggaggaagaaggaggcaggcaggaggcgggaggatcgtttcaccccaggggttcagggctgcagtggactatgatcatgccactgcactactgcctggtgacagagtgagaccctgtctcaaaaacaaacagacaaaaaaaatcaatgctcttagcatctgctgggtccacattgggcagtgtgtgtgacgtggtccagctgcaagggaggctgggaaatgcagtttcattatctgagtactagtggagaaagaagagacgaaagcaatgagaatccctgccatgaggaagtgagagctgattcatttcagcttccttaggtgaggtgatggggcccagacaggttctgaggccactggaggtcacacaggccagcagggatacacccagtggtagaccctggtctccaggctcccaggacacagaccacataaaagcaaggtcagtctcagcacacagatttaataagcactgtatgttattcctacagctgcaggaaaccagggggaagatggccacagggccaatgccaggcagggcacagggtggggcccctcaagcagcatatggggaacaggaaagactctgccagcatggtcatggcgcacaggtggctacaatggtgggtaatgcccagttgggaggatgcagtgttagacggggtcttgtccgatggattccttagggggttatatgcttgggaggctgatacaatttcctagaattctgggattctggatggtctctgacctgctctaggggatctgggtctccagagaggtctcagctacaaaagtgaccctctcctgaccccaccttgtgggagaccccagtggtctcaaggtctgtgaataaagggacttacaaccaagatgcctcctgacagggagacgggggctttacagtcaggccccagcctacatcccttgccccaggggacggcacacagggtgtccaaacctacaaagggcagcggagtgaaagcaccagggccggcttggggggtaagccagccccttctcaaggggccagtaggccacagaggcggcccaggcaggcagggtggagtagctggctgtgctatccgaggtcgctgtcctaatcagagcagggccgggagagccaggacaggaagtatggagagcagggagcgtctctccagggccctgcctgtggaggacaccttgggggtgggagccaagtgcagacttgaggcaaaagcctgtctctgccctctgcctgcacccccaccccaggcccttcatgcctccacccaggcccaccagggacggaagggtgtgaaggtgacagtgggggaggtgccagctcaccctcccctccctgcacctacctgcaggaggctgtgctccgggtctccctgggggttcagctggtccagcaggactgggggccacccgctggcaaaggcctgaatggcaccatctatggagggaggggtccagggtggacttagctgggaaaccctagcacagggctcagcacaggggacaaagtgagagaccccctgctgcaaagactggctccttggacagaaggtgtgtggtgaggaataacaaaataataagcacagctgtgacagagtgactcaactgtacagtcttccattctcccctctaaaatggctcccagccaggcggcttgggagggggcagtaagcgccgcccccactccccctccactcccccccgggcccctcacccaagcagcggttcctggtaaagagcccccggaaggcttcgcagtcctcacgccggttcccgctggctccgcagtcgcaccagggcgccacgcgcgcgctcacgttgtccacgtagttaggggtgacggcggtgcctgcggggaccctgagggcgaagtcatcggcccacccgggcggagatatcccctggagaacccccgccctcgcccggatcccggccgcgcgtacccacgaggcccgcgtaggcgcgcaggcagcgggcgccctggtccagcaggcagccgtcgggggcgctgggcgctggggtgcacgagacctgaaaggccaggaggcgaggcctgcgcggcgggagggcggtgagccggagagaggccccgtccccaccctcgccacggccccgccgccgcccgcgcgcacctgcagacccggctgcgctcgcagaagtttaagggctcaaggcaggagggcggcgcggggccgggccccgaaaaggcgcaggagggcacgaaggtctggcgccgacgctcggcgcacgcggggcccgcgcacgggcagaagagcagtgcgtgggtgagcgcgggcggcccgcgggcgaagaagcggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcaggtctcagtgcgccccgcatgcacacttcacccagcccatccacgcccctggaaggtgggggacactgaaaacccgagaaagcatagagtgtggcccaaaggcggggccgactggcactgatcggctctccgtcgtggggatgggcagcggcgggctctggagggctctgcaacacgtcagggatggagagggagcatggaggctgagccaggccttccccaaaagctgaagcccctccttcccaagcatcgccaccatttctccagaacggccacacacgtccaaagacgggtccaggggctcctcctacactcaatggcactacctgacgggggaacaatgaggctttctggggatctggccaatggagactttaaaaccagagatggcatagaagacagtggctgctcctagtctcttaatgacaggctgtgacgccatacctttcctcctctaccccctccacctcgccgcttatcctccaccatggagaccctttgggtgggtctattgatttctgtttctccctccttcctgacctcctgctcctcctcctgccccctgcatgggtgtctcccctctccagcccttcctgatgctcccttgagtcgaggtcatcctgccccatctgcactggcttcctccagcccctccacccttcatcagccaggggagagcggattcatgcaagagctctggccactgaagaacccactgagtcctggctgccagggtgtggattcagagaagtccctgacgacacaccgccgggctttgtcctgagccacaggacccaagggttcatcagtggttttagtgaccaggccccatgataggtgacaccctgctggagacagagaaggtgcctggcaccccagtcacacaccaggggttgggtagacagagggtgagctctgcccacatgcccacaggctgtgtctaaatagagccaggataactggaagttgggacttggcagccccttcccaggatttgagtcacaaaaaccaggctaatcgaatcccccccagcctccacaagttctccagtctggagcatctcattcagactagaagcctttctggtgcccagcctgagtggacgtgcacagcctggcccctcatccatctccctgtgtgtttgtgcacaggggctacggggtggtatcccccccccagggctgggagcagggtgcctctctggcaatggctgtgtctttcaggctgtggattggaccgcgtggtgagagtgattcctgctgtgacttcagcacctgcctctgcaggaaggatgaacatagctcgagggcttagaatggtccctgagtggaggggatagatggcagcggggtgagtcctcccttcctcccctccccaaagggcacactttgctttcctctcacagccttgccaggcacatcctcaggtctcagctgcacacaccagcacctgatgttgcctaagggtttgaacccacctctgcctgttgcttacctgtcacccttgcccagaacacccttacccagtctccaccctcacagcagctcatctcagctgcaagatctcctccaccttaaacctttaccagattccactttccacactacactcggtaaagtgacccctccctccgcgacatccatgcagggacggagcagtccaagaaggtggaacaacagatgaacaacaccgaagattcaccaaggaatctgtgtgatgggtaggagggctggggctgaggggagggtgagagagttgggagatggcagacaataggcaaaagttcctggggcacgggtgccaaggctggactcgggagggggatggcggtggtggcttgacggggctgggaggtgaggtgctcagcacatagtggggtcaattgccaggggtccccaagccgtgcgcacaggcctctcactggcaacccttcctgtggttcagcttttcctggaatatcttgccctcccaccttgtcactgaggagcagggacagagaggccagggttcggggtccaggggaagagaggggcgctcacccagtaacagcagcagcagcagcgcaggccccaggcagcggaccatgctggaccttcaacagagaaggatggctggcagagccctagtctgataggcgcccccttcctagtgcctctggagcaggagcacagtgaaaacccagctgtctgcgctgatacccctgggaggagcctttgctgcagcaactccccgccctcattaagtctccaccccaggctgcaccgtcaggtaaacctgggagccacgggattcggcgcctgaatgtgcctagacggaccccaacacactagccctgccacgcacacccagcaacacacagacaaccacccagggagacctggtctctcccatgctaaactaggaacgctatgaaacagcatttttcttttccttttttatataattctattttaaacttaaaaaaatttttttgaatagagttggggtctcgctctattgcgcaggctggtcttgaactcctgggctcaaaccatcctcccacctcggcctctcaaagtgctaggatgacaggtgtgagccaccatgcctggcctattttaaacttcttattgttgactaattttagacttgcagaaaagttggaaaatgtaagcattttccttacacccttcacccagcttcccctgatggtccatcttacttaatcatagtccaatcattacagctaggaaactaaccttggtacaatcctgttaacgaaactgtagactgttttgcatttctcatttttccactaatgtcctttttctgttccaagatccattctaggatcccacatcacagttgtctccttattctcctcaatctgggagttccttcatctttccttatctttacccttgacacttttgaagaatcctggccagttattttgcagaatgtttctcttgagttgtctgatgttttattctgatcagaatgagacacagcattgttttgactaaccaaaaagttattctataagtaaatattgaggttaaaaatctcatccaacctgggcaacagagtaaggccctgtctcaaataaagtctcaacactaagatttaaaaagtgaccagaaaagcccccactatgatttgtcttgacttttttttaaaaaacaaacaaacaaacaaacaaacaaacaaaaacgatgtcttgctctctctctccctcaggctggagtgcagtggcacgatcttggctcactgcaacctccgcctcccaggttcaagcgattcttctgcctcagcctcccaggtagctgggattacagacgcccgccaccatgcccggctaatttttgtatttttagtagagacaaggtttcaccatgttggccaggctggtctcgaacttctaacctcaagtgacccgcccacctctgcctcccaaagtgctggaattacagacgtgagcaactgcgcttggcctcattagcatcttaaatctccacacaggggtgtgttccttactattataaggagcaaaggatcagtttgaggacaggtaaaataaaaatgcgcttgctgcctagagggagaagtccctgctgaagatagctttgcttgaatgagctcaattgcaatgccagtgctgaggcttgttgactgtacggtcaccacagttgctgctgcgcgcctagaacatggtcactttcttgactacctatcctgtctcagtacatctgtctgtggtttgtggtggtccatttcctaatttttttaatgaatcagaagactgtgatgtgctttccgctgtgctaaccatggccgctgaagcaaaatgtaaaccaagatgcccctgcagtggttgtgcttcactctacgacatctgttaccggaaaggggtccagattcagaccccaggagagggttcttggatctcgtgcaagaaagaatttgagacgagtccataaagtgaaagcacatttattaggaaagtaaaagaataaaagaatggctactccatagagagcgcagccctgagggctgctggttgcccatttttatggttgtttctggatgatctgctaaacaggggtggattgttcatgtctcccctttttagaccatatatggtaacttcctgatactgccatggcatctgtaacctgtcatggcgctggtgggagtgtagcagtggggacgaccagaggtcactctcatcaccatcttggtttgggtgggttttagccagcttctatattgcaagctgatttttttgtttgttttgttttttgagacggagtctcgctccaggctggagtgcagtgacacgatctcagctcactgcaacctccacctcctgggttcaagcgattctcctgcctcagcctcccaagtagctgggattacaggcacacaccaccatgcctggctagtttttgtatttttagtagagatgaggtttcaccttgttggccaggctggtctcgaacttctgacctcaggtgatccgcccacctcagcctcccaaagtgctgggattacaggcgtgagctaccgcgcctggcctactgcaaactattttatcagcaaggtctttatgacctgtatctcctatctcatcctgtgacgcagaatgctgtaactgtctggaaacgcagcccagtaggtctcagccttattttgctcagcccctattcaggatggagttgctctggttcacaggcctctgacacatcctcttgtgttttggcgtgtgggaggaaagaggggtgagggaaggaaactcaaaaccaagctctgaccacacagggcaggtacactctcccacctgtctgtgggtgccacaagtcaagggaggggcagagagagaagaaggtgtgacagatggccgcaggccacagaatgtcagaggaagcccagttcctcccggggcagcccaagtagctggtagttgggtggccaaacagagggcgtcacagctgagctgggctcgctcgctacccccagctcagcgtccactctgcccctcagtacctcctgctcagcctcagggtccatgcctaccctcctgcttcccagtcacttctgcgtgcctcctgcttttctgctgttggccccatgccagctcctttctgctgagcttctcttctccagttctgcagcacagccaggtgatcctgggctccagacaggcctctcccccagtctggggcctcccctcttagagccctctttccttcccacgtggcctccccagggttcgccactgaatggagaaggggtggagggggtgctgggcagtcttggggaatagccaagagggcagagttggcctccccagggtcccttgtagctggagtcccgcggggtctagacaccccctcctgaagggtaagagcgggggaggtatattaacgtgtatttttagagtctctctttttttttttttttttttttgagacggagtcttgctcttgttgcccaggctggagtgcagtggcacgatctcagctcactgcaacctccacctcccatgttcaaacaattctcctgccgcagcctcccgagtagctgggattataggcacgtgccaccacaccgggctaatttttgtatttttagtagagatggggtttcaccacattggccaggctggtctcgaacttctgacctcaaatgatcctcccgccttggcctcccaaagtgctgggattacaggcgtgagccaccatgcctggccttagattctctattttatgatggtttaacatctcggggtgggggcttgttggctggagagaaactgcttgattcctggagatcagaaacaactcatgcctttcatatgcaaaccgaccagtcttgagtccatacaccaaccacccccttcaaggaactctcacatacgaaaccagtatttcccctgccctaaaccagctcagggccaggcacctacccagacaattagagcccaaccccacgccccaaaccccaccagaatgattcaaaatgccaatcctaccctcttcccctggcctgccttgcctccccagtggaaacggcactgtgggctgtggcctgtgccttccactcgctcctgattctgtccctggaccaaacctagtgcctccccactgtggccctgcatggtgggaaactgtgagtaataacttatttcaacagcattggcctctgtgtcatcagtcaccttcataaattaaaattttgcaactacaactgaggcaggagggggctttagagagcactctcacctggccccttgggcttgtggagtggagcccgaggtgaagttgcctccctgcactcagttttgggatggttttgttatgcggcaacagctggctgatataggccactcagcagctcttgcatgaagcaatgggagaatgtgaacgcccaagggaagcaggagtgacagagcaaagagggtgttcaaactaggcaacaccgtcctgtgcccagacacatgcctggggctctggctgccacctaggctcggcctgccagccaccaccccgtcagccaccaccccatcagccaccaccccaccaaccaccaccccgccaaccaccaccccgtgtggtcctcagggcaccccatgggttgaatttacatacagaaaagactaaccaaggtccaagtgtaatatgtctttttaaaatttattttagagacagggtcttgctctgtcacccaggctggagtgcagtggtgccaccatagctcactgcagtgttgaactcaggctcaagtgatcctcctgcttcagcctcctgagcagctaggcctacaggtacacaccaccacgcccagctaattttaaaatttttctgtagatgcggtgtcttgctgtgttgcccaggctggtgtggacctgctggcctctggtgatcctcctaccccggcttcccaaagtgctgggattataggcatgagccaccacgcctatagccaacatgtctttcttttgacttctactttggtatcttttcttaaatggttccctctgtccccccgacacacacagaatgggggagaggctgtcagattctgagctccagaacctcaggtgtagcactgggattgggggtgggggctcaggaaccacctaggggagaagacagggtgggaagaaacaggaaggaaggtccccaaaattatgtttgtttgcagaggccagccaggctccaggggagtgtggactcagtcgaaccatagggccccaggaccactagcttctggccagcagtcatgccctccacagagctgggtccgtggaaattgcatgtaggagacacaccagactcccaggacagagcccttttgggatggccagcactacccagcctccactggtgagggaggtcaggggctgtgtgacctttgcttctgggactgatggtttattgagctggagagtgtgcccagcagtgttctccagccctcaggaacttctaatgtggctctgggttcctggagtgggtgggtcgaagctccactcggggaagaaacttccaagctgcctgcaggtgctggaggtccggtgattcactggctctgcccctgcagttcaagttcctggagtggctgtcagtggccacctgtctttaaatctgttcattttaggagctacctctcaccagaggcaggatcttggcatctggacttgatctgctgagaatgaggaggatatgttgtcccctaaggactggggccccaggctgcaagctgtgtggcagagagcccatcctcactcagtgaggaccagtgatccaggaaaagccacagcttctccctccccagcccaggggcttccagcatcctggtctgcatgataaccaagaggtcataaactcatttccataataacctgagcccagaaacctgattagggggcagcaaactgaggggtgggagaggtgggagggtgggcgatgagagggggaggctttgaatccaggtccctgcctaccttgggggtcaggcgagactgctggcagaggcttctcagggtggctgctgggctcatgagagttctcagggtctgggagaaatggtggagggtaaatgttgtgaatatggtcagcaggagcccctggggctggggaggggcataggggactcaaggtgactgggtgctgcccatctggaaggaggcaggaggcatgagcccttcccttctcccttccctctccacctccccctggtgcctcactcacccaggggccagggctgtccagtggctgtggggcccaactccatggggtgaacgccgcccagggggtggtccctgtgtgggccatctttggggctgagcaacgtgataagagtccaggaggttggcacagtgatcctgagtgggttattgcctccccgcagcatggtgtccagcccagggagttctgcgtttactgagtttcttggggcacccatctgctccaagtcaccctctcagctcccttcctgctccctcttcaggggagccttgggatccaggctccaagtgagcctcatgccctcggctggcacctcctctctctagtcctaacatttcctccaggctctgacagcagcctggcactctccagatgctggcatcgctcagcttccaaagaaccttggatgtccgccccttcggcagctatgtctgctctccttgcccctgggtgccctgctgcccttgatgattccaagccatctttgactgtccccatcccatcccccaaggccttgtcatttcctgtgatgttccttcaaaacattctcccctgccctgagactcccgcctggggatgagaagcagccgccaccctctgcagcgccccctccgtgctgacacgccaggctctggccaccttgctcctctgcccacagaccctcaatcacaactcgctttgtcagggtcctcttagctgccacccggggcccaggtggtgccctgcccctgtctgttatgccctctgcccccatctctggcccaaatcatgccatctcccttggcttgcccggagcactcccaagaccaggctatgtcagacatggccacagagtgcctgccctgcctagggccctggtgcagggtgagtcctaggacagccatgcttagtattatgtgactccccactccgccaccacccaggtcacagagaactgggttaaggcagggccctggcacaggggcagccagcaccgcagctgaccagtggtatggagtgaaaagatgtgctgggcccagcatttgggaacttcaagggggtgacagaggtgatttgtgcagaggaagtggcaaagggccgaaaactggtgagacagaggctggacaggcctccgggggcagcatggtacagggactgcaatctgagccagggaaaaacagggcgaagtcaagggtgaggcagccagctggtgggagaagcaggagagtggacaagaggagctgtactgggaggtagagggccatgccttgcggtgctggtggtggggcagggatccaccccctcgcttgactgggaggccactggaacctcctgttcaaagctacttctttccatggcctctggggctgctctctgcacctgggggcaaggctgagggcctgccccagctcccacagccccagcagagctctgaggaggggaaccgcaggagtaggctcaggaagcaggcgctcggagcctacccactgcacgcagggtcccttctgcagccccagctgcatcgctgcagatgggctcctgggagtcggtagcaacaccaggccaggccggcccctgggagcagaggcagcaggacgctgaggagcatggccagcaggaaggtgtcatggtctgcggggattgggggaaggggcgctgagtcctgagcaggtgcaccaccccagctcctgcccacatgccccccactggcatactttcagcctgcacagggccactgtccatgctgccaccaaagcctggcttgtcacagaagggtggagcccagcctggagcacagtggcagttatggttgctattgcaaacctgcagagaagagaagaggagggtcacgtaggattaggaaccccaaggtcacccccactcctcgggctctcaccccgtggctgtggcaggcagtcaggcagcgctgaagctcctggaaggcattcttcctgcagcgcctgctctggcacacctacgggcagtgcaccaggcagtgagggggacactggcctgcgggattcaaacggcaaggaggggtcgggtgggcagagctcaccattctaggtccacactgggtgcctggctctaccaggcccaggccaagcaggtccagctgggcactggggagtgccaaggctccccgacaagtcacttcctggccatctaggtgaacggtagagtccactggcaccatgtgcggtgcgagcaggctgggctttccaccctggcactgcagcttcccacacagggcatccctggggaggaagtagaggggggtcaacagctgcagtaccccccttccccaaacccactccatagcttctgctccctccactcagctccactccctacctccctgcacagggcaggaagtggccctcgctgtcctggccgcagtttccatgagcatctcccgcagagttcaccacctggaaacaggcctcgggagctgggtgggagcctgaggaagcatgggccaggctgggggcagctcggagaggggctgcgctcagcgggcctcagtttcccctgcccatcttccccacagtagaaaactggccccaccagaggatggggggcagggtgcaagggtgctcgtgtcctctcaccaggcccccagagctgctggcactgctgctccagcgtgggacatgcgccatcccagcagtagccactgcccctggcacagggtgagccgtccagtaggtaaacgtctgggggacagtgggaggaggtgcccgtgcaaaactcagggaggtcacagtcacccatggcctggcggcacagcgctccagccggcttcagctgcgcaggtgacgggtggtggggaaggcagagagaggccacgtgcagtgagaggtccatgccgagagcgcggctcggagctgggggagccaggcctacccaagcccagcacccaacgggggaacctgagggcaccaattaactaaggccaacaggccggctcccaagctccccgaaaccctcaccctgaaccttccatgccctcaccaggcagcgcacgcagcagtccccgtgggcgcactgggcccccgggcgcagcgagcagttgtgagcaaagcagcagaggtcgcggcactcctgggaccagaaaggcaagaagggcccaggtgagggcgcagcgccccagacctgagcggagagggcaagtgggggccgggcgagccgacttaacctggccagggccgcagtcacactcctcgcccgcttccacgaagccgttcccgcagagcgccggcggcaccgggagtccggggtccggggcattggagaggcaagcgccgccccccttgcggaagaaggcgcgcagctggcggcggctgcaggcgctgaacacgcgcggaaacgggtgcctaccggcacggggagggcattgggcatggagggacagtcccccaacccccgcgcttctctgatccccacccctgggcttggctacagccgccagacgcgcagagcccagagaggggaagtaacccgcgcaaagtcacacaacaagcgggacaggggacgatgcggccccaatagtgagcagcccgggacccaaggtggaatcgcgacccgacggtgctcctcccggtgtaggagtaacctcgccaggttactcggaaaataatcttcataccgttgagaatccactttgcctgagcttcttccctttaagcctcataaaccaccctgaagcggacactatgatcattatccccattttacagaagaggaaactgagggacgaccaaagaaacgcagcggaggaagtccccaggactagccgccccgccgcagccccgaccccccacccgcgtacccggtggccgcagccatgacgcagcctccggactcggccgcagcctccacgcagcagccgtcggggtcgtggctgaggccgaggctgtggccgatctcatgggccatggtggctgcggcgccgatggggagctccgagtggtcctggggggccgtgggagggcggtcactgcggccgtagagcctcctgtctctccctcgcccccgcccgcggggctcaccgtgctcacgcctcccgagctctcggcgcggcacatgccctcgacgggcgccaggcccactgtggcgccctggaaggcgcggcccctgggggcggagcgcggcgtgaccaggcggggccgggaggtgaggccgccccacccgggacccgcgtccgggtcagaggcacccacgtgagcagctgcgcggagtcgtggggccgctgcgcccacagcccccggcgccactgcaggaaggcccagagcgtggcgttggcgtcctgcgtgacgcggctgcggtcccgctcggtccacacctccaggccggtcagcgccacctgaatgtccagagtcctgagaagctgagggcgaggcggggctgaagccgggacagggcgccccatcgcgccggtggtccttcgtggggcgcccttcctcttccccaaaccccaccagcacctgcctgtcctgccgccgccacccccatcaccgctctctccccgccgcccccaacctggtccacgtagttggcgacttccaggagacgctgtttggtgtggttcaagtttcggtgccgagtcaagaactgggaaggcagaaatcccggtggcttgaggggctgagctggccccatccctgaccccgccaacccctggggtctctcctcaccagggtgtggtctgccacaatgtacagttccaggtacttccgggtcctgcgcgcttctcgcctgccctgcggaggtgcaaatggggaccctgagtggaagctgctgggcttgagccctgaccaccaatcccagctcccagaaggaagtttaacatgttttctggaacttgtttcttcagacttcaataaaaatactgggactcgaggcctgtgaattcccgtctcttctgatttggagggctatagatacagcattcccactcccatccgatcgatgcccctgaccctgctctggggaccaccaggaaggctggtcatgcccgctttgttcccaggatccctgtggccacaggttcctttccaggtgagcagctgctccatccgaaagatctcgtgggttgagaagtccttggagccccggggtggccagggacgcagataatagctggcattcctgctgagggtgatcaggccactagggtgcagaggggtaggagcgggtgtgagggagctctttccccatcccaggcccagcctcctctcccagagctcacctcatcccagagcaggtgcagaggactacccaggagtcggggaagccccttactcgcccttggtagtggcaatgatcctagggaggaaggggccagccccaaatctcagccagggctggagcaagaggggcaagagggagggtgtggtaggggctggctccaaccgccccttaggaatgcaaggaggagtaggggtaggaatggtgggggggtacctctggcggtgcatcccagagcccatggaagcatctcaccgtgtggttgggggccagcaccactggctgcccatctgggccgtagtgggtttctatgtatcctggggccagcagcctgctgagagggggtgttacagggaacactgaattcagcttcctcctgcctcctccaggatgtctcccagccttcctccctaaatgctaatggagcagctttatgagtgagacactcacagtgtgtcttagggaagggacaggagcaatggtgacttgctcagatcagaaactcttggggctagaggaaggagccttggtgatggcttagttgtgggaggtgtgaatatgggaagcaccagggaggacgccggggaggagtgggaataggggaagagtttgtggttcccaggggacctgcagcaggcagcaggatccacaggatcgggaggggaggagtcaggagacactgccgaagaatgggacttggagttggggaaatgcggtgacctcccccagttcccctgcctgct

SEQ ID NO: 398 - DNA, 572 bp, Homo sapiens
tttcattattaacaaatttattgaacaactagaacttgacaagcacttgcccagtaaaggggatacagtggtgagcaataatagtgatgataatgaggagcagttttccctagcaggcagcagttgaaaggaatatgggtttaacatccaccaatgaccaggagtggacagatccttttccaggagactgagtccatagtgggattaaaaacatccctgtaattcttctagcttccttcatccaaattaccaatattacagagaatctctaggggtatttgctctgcctggaaaccttgactgaaggaaggctggctctggctgcacgatcacttatcacatttgttgggtgggaacacatctgtgccccattattaactgagtgtggcctctagtctctttcaaagtcacatgccctgtgggaactgcaacgttattctctcaaccaagacactctgcagagccaatccaaggagtgctgggtctaaggctctgataatcagctgggaaggagtccataggggtcttaactccacaaccactcacagtgatctcgatcctggagctgtcct

SEQ ID NO: 399 - DNA, 457 bp, Homo sapiens
  modified_base (243)..(243): a, c, g, t, unknown, or other
  modified_base (318)..(318): a, c, g, t, unknown, or other
  modified_base (371)..(371): a, c, g, t, unknown, or other
  modified_base (426)..(426): a, c, g, t, unknown, or other
  modified_base (442)..(442): a, c, g, t, unknown, or other
ttttaattttcatatttcattttttattagttttgttttttttttctggtagacagtacacttgggaattatactgcaccaggcataaagagtaagttttctaccacagggacattttgtattcagaattcaatataaatatttctagtcagacatttccatggctacagatatttggttccttgatttatatgcatagaaagaaacagttgtcataactgtaaaaagcagtacttaataagnacttttaaatgattgggaacagttttcctttaatattacaatactacttatttattgggtttgggaaactagggncacccctacatggatgttttggatttttctcaaagggcatcatgaggtactcnggcttattctttcattcttggtatttttaggcccttctaggttgagttagggggncccattttatcagggnaatcattttaggcca

SEQ ID NO: 400 - DNA, 2280 bp, Homo sapiens
atctggaagcataaatggggaggggagagcccactgggtagaaggaacagggagcggccagggtaagtccccactctcagagaccctgacatcagcgtcacctggagcagagtggcccagcttcagactcagagcaccaagacccaggcctgcaggcctggacccaccccggtccccccgtcccagctccattcttcaccccacaatctgtagcccccagccctgccctgtgaggcccggccaggcccacgatgctcctccttgctccccagatgctgaatctgctgctgctggcgctgcccgtcctggcgagccgcgcctacgcggcccctggtgagtcccagccggggtccaccctgcccctcaccacattccacaggtcagggcctgggtgggttctggggaggtcgggctggcccccacacagggaagggctgggcccaggcctggggctgcttcctggtcctgacctggcacctgccccagccccaggccaggccctgcagcgagtgggcatcgttgggggtcaggaggcccccaggagcaagtggccctggcaggtgagcctgagagtccgcgaccgatactggatgcacttctgcgggggctccctcatccacccccagtgggtgctgaccgcagcgcactgcgtgggaccgtgagtctcccggggcctggaggggtggggaagggctggatgtgagccctggctcccgggtgctcctgggggctgcccagggccctgagtgggatcctccgctgcccagggacgtcaaggatctggccgccctcagggtgcaactgcgggagcagcacctctactaccaggaccagctgctgccggtcagcaggatcatcgtgcacccacagttctacaccgcccagatcggagcggacatcgccctgctggagctggaggagccggtgaacgtctccagccacgtccacacggtcaccctgccccctgcctcagagaccttccccccggggatgccgtgctgggtcactggctggggcgatgtggacaatgatggtgggtctggggacagtggaggtggggccagggtcttagccacagcccagcccctgggctccctctgggctccaggtgggggttgcccggccccctcctgaggctgcaccctcttccccacctgcagagcgcctcccaccgccatttcctctgaagcaggtgaaggtccccataatggaaaaccacatttgtgacgcaaaataccaccttggcgcctacacgggagacgacgtccgcatcgtccgtgacgacatgctgtgtgccgggaacacccggagggactcatgccaggtgggccccgcctgtcccccgccccccgccccccaacccccactcccaggcctgttcggcgagcgctgacctctgaccttcccagggcgactccggagggcccctggtgtgcaaggtgaatggcacctggctgcaggcgggcgtggtcagctggggcgagggctgtgcccagcccaaccggcctggcatctacacccgtgtcacctactacttggactggatccaccactatgtccccaaaaagccgtgagtcaggcctggggtgtccacctgggtcactggagagccagcccctcctgtccaaaacaccactgcttcctacccaggtggcgactgccccccacaccttccctgccccgtcctgagtgccccttcctgtcctaagccccctgctctcttctgagccccttcccctgtcctgaggacccttccccatcctgagcccccttccctgtcctaagcctgacgcctgcaccgggccctccggccctcccctgcccaggcagctggtggtgggcgctaatcctcctgagtgctggacctcattaaagtgcatggaaatcactggtgtgcatcgctgtgtttctggttgtggatgtcactgggagagaaggggtccaggtgtgctgaggacacctgccacagtgtgaggtcctagccctcaaggcacagccagtcaccgtgggacggggcctcctgggcagccctggtccccgaggctggcttctccccacacgatgcatccagcattcgggtcacacagagccactcgggcaactcagttgattataaaggacagccaggtccctgcaaccgggtcaagacagaaatggtcaccgggaaccccagggctgcccatcacgagcccctaccccacgcttcccacgagctcttctcccggccctcccgtccatgcttgtgctttgcctaattgtttgcttttgagaacgggattg

SEQ ID NO: 401 - DNA, 478 bp, Homo sapiens
ttttttttttttttaagtctgaagacattttatttttcctatgtgggaagcaatgatgatcttacactttttgttttctgtttttaaaaagggcagcacaaggatatgtgcagattttcttttaagtaccttgctaagcgacactaaactaataaccattttctagaattaggtgacctacttctgaataaaattgaaactggattgcgtattcccttactaataataatactaaatatattcttaaatcagttttcaaaattcaagatgaaatctagaaatatggaacaactagcaggaataagcccgaagatgattctagctccgttactactaaaacctagtttctaaactttcgaggattttatatgaactcgcatgaaaaaatgagctcagaggctagaatatgactccagaacataccttggtcgggtatgttcatgctcaagtaatcagactctgctccaaatttcttgac

SEQ ID NO: 402 - DNA, 1951 bp, Homo sapiens
cttttctctcctccgcgccgccgccgccggtgcgcaggccggctggggactcgcctccgctcgggccttcggtttcgctccctcgctgagtcccttctccccgccaacaaaaggtgatgattcctagcggactgggcacgcctggacggcggagggtggctgggaggggcgaggtcacgctagcaacctgtggctgccaggagaaggcggctgggaagccacggaaagacccgggagcgcaggggaggtggctcagctcgcgcgcagcccctgctcttattttactattatgcgtgttgctgttcgtatccttctgggcggtgaaggggagaggcagcctcccgctccggtgaaacccgtcctgggagtcgcccataaaccctgttctccatctcgggcggctggaggggtgaggggggtgcggcgccttggtgggattggcaggtggtgacttccagggcgcagaggagaaaaatctctgctcttgggcgccaggatcaaggatacccaaacccgcggtggctctgccgcctgttcctctctcttggggtgctggggcacctgggccgcatcccttgtgaagtgtagagcagcagagaggcccggccgccggcccagcggccctcccaaacttccgaaatgccgacgggttggacgggtttccgagagctggcgagttgagaaggacaggaggtgtggggtgggggaggggcctggaccgttggagtgggtcctggagaccctaagtggcctatgacaagatttggaaaggtccctggttgacgctagggagctggtggggatcctagcagcgcattttgtctgtgggccctgggccagactctaggctccctgagtgcccagatgggggtctgagattacctattggaccctctcttggcaaagacaaccatagtgtgatagtttgcttttttctcccaaatatgtgtgagttcagcctgtctgggagaatgttgatgttagaaatcaggcccagaggccaacattggcaattcctagatttaagattaaaagaaaatcagagggtctctggacctagttgtgggcaggtgggaactctcctcctacccacctgcaaggtcccaggactgggcataggcagagatctctggagtgttgcagttagagggttgtttttgtgttgttcctgtatttgttaatgaaattgatattattttgacttcctcactaaagatgcaagtatttctcagacctagggagttgagtagggagtctgggtggggtggaggctttttctatgcacattttcccttactctgtcacagctttcacagtctcagttccctccagcccaatccccagactctcagcttagtaaattcacggcttctgggagcttcagaaagttggttcgtaaaccccagacgcccattttggccctaccaccagcaacccaagcaggtggctaggcgagttcatatgtgtttagaaggaaaggacccgtctggggctaggaaggtggggaaatggggttcctccccacacttccccgggatagaccctctctcctggctcccaggatgtgtgagaggctgggaggggccctatatcatctggctgcatctttaacggttcctcattgcccttcattcggaaatgaaacgcctttgatcttttctcaggttgtaaacggaattgcccgtcattaaatatctggggccccatctgcttggtctcccagcatttttctttacagctgtttctctctctttttaccactgaatttttccaaaaggacttttattacaccaccttcacacccagccgcctcttcctcctcccttcgctgagaggcgctttggaaaatatctagatattcgtttgatcacaaactaaaggcttggaggggcacggaggagccgattggggttttgttttttctaaaaaaaaaaaaaaaaaaaaaaaaaaa

SEQ ID NO: 403 - DNA, 514 bp, Homo sapiens
tttccctaaaaaaggcttatatttacttgatttgaattttgctagcatgctttttcttctgaattcaagtgactagaactgaaattattccacctggggagaagaaacagctgaaaccaatttagtattggttttcaaatacatgaagggtactcagagagaggatgattgccaaagaaaatggtctttgaaccatagaaagaatctgagcttgctctaaagttaaatttcctgacttacagagtttatgacattaaactgagagaccaagggatcctttttggagacttcaaaaataggatagatcctcaaatgcctgagatggcttggatgtggctttgtctgaagtcaggaggataaatcttaccactgatggtcccttcaggcgtgtgaatctatgggtttgactggcatgtcagaagctagaatgccagcccaggacatctagagagtcatctctccaatgctgggtagcagtctatcaatcgctctcactgcctcaacatctctcagc

SEQ ID NO: 404 - DNA, 2965 bp, Homo sapiens
gcggaggtcggcggtcgggtccgtctctgcccgcggctgtggcggcgccggcggatccagccttagcgttcctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatacgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacagctaatgtttgaagagaagaacaaagctcagagattacagacagaattagatgtcagtgagcaagtccagagagattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcag

SEQ ID NO: 405 - DNA, 810 bp, Homo sapiens
gtattcttaaattcagacgggaagattctttcacatatcactcagttacctcccaatctgggggagtttttcttacaacttgataccagataccattaattttacattcctgaataaaggcctagtacccacgcatatttcaaccatgcatatatcaagttcaaccgagttttaataggggattaaaaaaacaagctgttaggtttccatgggcactggttctcataggttctattggtgataactgctttaacatggagcaagagtttgtgaatcaggaaatagaataaattaaaatttaaaatatatagaggaatcctcttgattgctcagcatgatgttagataaatgagtttgtcagaaaatatcagtatacgctgtttaccaatgttatttatttacattcttctaaagccattatggatattgtattatgagagataaacctaaataagttatcctgttccctaggaccttctctgtaaatagtgaattttagacgagtagtctgtcctaaatcttaaatagaaaaaaaaactaaagcgatttgcttaagccattgtacattataaagagctgttttgttttgctttgctttgctttgttttgttttttttaaagctgcattcagagccacaaaggaataggaaagtagggtagtgttggattctggttttatgtaactctaaaataaatgtatctctttaatatctcagttgtagggattttgtcaataccaaagcagactgagttgtggttttgtaaataaagttttttctaaaaatgaaaaaaaaagaaaaaaaaaaaaaa

SEQ ID NO: 406 - DNA, 1009 bp, Homo sapiens
gcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttcccc

SEQ ID NO: 407 - DNA, 582 bp, Homo sapiens
cactgattctgcagaagctttatttattggtggattcagattcagcgtcccgactcagttactccagtaccatcagccaccaccacacagatggcctcagctcggatggccccataccccaccctagcgacccacgggtgagtttgctgagtatgtgagattaactggtggctcagtggtcggctcctctagtggataattccattcaaagccaatgctcttgatgccaaggagttgatactggccatagatgcccaccagcacctgcccctcttggctggggtaggcagaggagatctggccatcaagcttcccaaaatagaaatagcggtccttgctggtgtacatgaccataccccggaggaaagcttggaaggcgacaaagacttttgtgatgtattcgcctggctgcagggtgacttcctgggtattcccacctaaggctcccagtttcacgtcccaagagtctccaagtttcacctggacacttttcaccaggagaagacctacagacacccgcagccctgtgatttcatggtcgtagtcttcagtggtgctgaaatacttgcctcctccagggcc

SEQ ID NO: 408 - DNA, 10096 bp, Homo sapiens
ggagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagaactcttcagaaaattcaagagcttgaaggacagcttgacaaactgaagaaggaaaagcagcaaaggcagtttcagcttgacagtctcgaggctgcgccgcagaagcaaacacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaactagaggtgactccaagtcgatcaactttgcaaatagggaaaagagatgctaatagcagtttctttggcaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctttaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggttgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatat

SEQ ID NO: 409 - DNA, 449 bp, Homo sapiens
  modified_base (249)..(249): a, c, g, t, unknown, or other
tcatgacttcccaggagggaaaaaatgtgtttatttatttaaattaaaaaatattgtgaaaattacaaagtgttaaatacaaaagacaattctatacaactcaacagaataagaaggaagtatatacatcactttttaataggtgcagagagacttgcaccaaacttcaggattaagcaatggaaaatgtgacaaggcacatgtccgtcgcagtgaaatttcagaattcaagtgattccaggcaagagngcaaacttaacttggcttctttcaacttaaacagccccctttggcataagtccacactgaattttaaagtgaacagagggcctttttccccaaacataaatttcctttagctgtatgtcaaagcggactgataaaccagctcctacactgttaacccttccatggcaacagtagttattgctgtgtctccaatccatgca

SEQ ID NO: 410 - DNA, 884 bp, Homo sapiens
agtggccaggatgctgagcctgctgctgctggcgctgcccgtcctggcgagcccggcctacgcggcccctgccccagtccaggccctgcagcaagcgggtatcgtcgggggtcaggaggcccccaggagcaagtggccctggcaggtgagcctgagagtccgcgaccgatactggatgcacttctgtgggggctccctcatccacccccagtgggtgctgaccgcggcgcactgcctgggaccggacgtcaaggatctggccaccctcagggtgcaactgcgggagcagcacctctactaccaggaccagctgctgccggtcagcaggatcatcgtgcacccacagttctacatcatccagactggagcggatatcgccctgctggagctggaggagcccgtgaacatctccagccgcgtccacacggtcatgctgccccctgcctcggagaccttccccccggggatgccgtgctgggtcactggctggggcgatgtggacaatgatgagcccctcccaccgccatttcccctgaagcaggtgaaggtccccataatggaaaaccacatttgtgacgcaaaataccaccttggcgcctacacgggagacgacgtccgcatcatccgtgacgacatgctgtgtgccgggaacacccggagggactcatgccagggcgactctggagggcccctggtgtgcaaggtgaatggcacctggctacaggcgggcgtggtcagctgggacgagggctgtgcccagcccaaccggcctggcatctacacccgtgtcacctactacttggactggatccaccactatgtccccaaaaagccgtgagtcaggcctggggtgtccacctgggtcactggagagccagcccctc

SEQ ID NO: 411 - DNA, 575 bp, Homo sapiens
  modified_base (438)..(438): a, c, g, t, unknown, or other
  modified_base (441)..(441): a, c, g, t, unknown, or other
  modified_base (462)..(462): a, c, g, t, unknown, or other
  modified_base (476)..(476): a, c, g, t, unknown, or other
  modified_base (551)..(551): a, c, g, t, unknown, or other
  modified_base (558)..(558): a, c, g, t, unknown, or other
  modified_base (565)..(565): a, c, g, t, unknown, or other
  modified_base (569)..(569): a, c, g, t, unknown, or other
gaaattaacaaactaattttaaaaatcaacacctgactggggacctggtcatacaaacttcctttagatacagttgagaagaaaacatcacatttttatgaagcccctctcctgacaggggactggaggaggaacaccattatgcattgttatcagcgtggtgtaatttgactgttgacaaagtatccgtggcagtgcgaatgagcgcagttagaagtgtggcggattgtaatcaagaagatgcttagctgtgcaacactgcatctcgagcagatttgaatcaacattgccttaaggggacacacacacataccaaaagaaaaaaaatccattaatttttagagggaaaattagagtggcacttgatgaagtgaaatttgacatgcgttaattggtgtgcagctctcctaattagagattttcaaattcttttactgntgncaccatgaatggcacattgcnttgctggacaaatnctaaaattgcaaattggcttggtccggaagttttacgtttgaagataccctggatccttaagccattccaaaggngggccantggaaancaanatactt

SEQ ID NO: 412 - DNA, 535 bp, Homo sapiens
  modified_base (21)..(21): a, c, g, t, unknown, or other
  modified_base (428)..(428): a, c, g, t, unknown, or other
  modified_base (461)..(461): a, c, g, t, unknown, or other
  modified_base (471)..(471): a, c, g, t, unknown, or other
  modified_base (482)..(482): a, c, g, t, unknown, or other
  modified_base (488)..(488): a, c, g, t, unknown, or other
  modified_base (523)..(523): a, c, g, t, unknown, or other
  modified_base (531)..(531): a, c, g, t, unknown, or other
  modified_base (534)..(534): a, c, g, t, unknown, or other
gagacacgagtctcgctctgncatccaggctggagtgcaatggtgtgatctcggctcactgcaacccccgcctcctgggttcaagcgattctcctgcctcagcctcctgagtagctgggattacaggtgcacgccaccacgcccagctaatttttgaatttttagtaaagatgggatttcaccatattgatcatgctggtcttgaactcctgaccttgtgatccgcccgccttggcctcccaaagtgctgggattacaggcatgagctaccgagcccagccctaaaagacttctttataaggagccatattgctttggggagaccgaaggctgctgagggcctcagggcagggttgatatgcacctgccagcacgccaccataacatcttcatggaaccttaacactttcttaaaagtgctccacctncttttttttgacccttaaagaagagaccaactnttagtactgngtggcaactgngcctgnccttttacatgggcaggggactgggtgacacattnccccaaanggnc

SEQ ID NO: 413 - DNA, 617 bp, Homo sapiens
  modified_base (534)..(534): a, c, g, t, unknown, or other
  modified_base (554)..(554): a, c, g, t, unknown, or other
  modified_base (591)..(591): a, c, g, t, unknown, or other
  modified_base (603)..(603): a, c, g, t, unknown, or other
ccttttaagacagaaaaggttggctggatttaaaagcaaaaatgaattcaaattgtgacttttatgaagcaaatcctactttcaactgcacaaatcactcctttgttagattttcagagtagatggtaatgtcactaaaagctgtttacagcccagcaggtgtgttttggtttaaaaggatgtgctttccttttaaactcgagtattcaattaccttcccagccgcaggaaagtgtgagctagggaccaagcgagcttcagaggcagctctgaagatgcaggcaggagggagtggggcagggggagctccacaaggaagagcaacaggggagccaatgccttggactacgcgggatcagtctccttgctctcttcagaactgggaattctcacgacagatgcaccctcgccaatcacgcaggactgaccggggcgtcgaatcgccgtcattctagatgatctacaccttcccggtgccagacgcgccctcgccacaatcacgcaggactgactggggcgtcgaattgctgtcantctagacatctacacctttnccagtgccagacactcacggagcagacatgtgccgcnggtcatagttantgcctttgacgtta

SEQ ID NO: 414 - DNA, 489 bp, Homo sapiens
tttttttttttttttttaacaattatgcataaaagaattttatttagtggccagatcccaatgaataatgtcagtcattgcttggttctgctaaaatgtggtattagatatattcttaagaaagtgtacaattgcatcaccaaaagctgtttaatttggattgtgtagaataaaagaaaactacataagtctttgttctttgataaaaattttaaaatataaaaatgaaaaaaagaaacccaaaagcagtattcaaaactaacaaatgtcaccttggactatttacagtaagacgcctttttgacaggagaatcttgttctcagcttgttcttttcctcacattttacttacagggattctcactcccccatctgatccctattcataacttcttccattcctgtctcacatgaaacagccatcttccatgctctctcactcatctttgagtctctctctgacactcctttttcctactcttaaattat

SEQ ID NO: 415 - DNA, 372 bp, Homo sapiens
  modified_base (201)..(201): a, c, g, t, unknown, or other
  modified_base (229)..(229): a, c, g, t, unknown, or other
  modified_base (245)..(245): a, c, g, t, unknown, or other
ttttttttttttttaaactggaagaggatgcacaggggaagaaattgaaaaaaaaattttgttggcttttgtttacctggcgtgtgtggcagccggctcgctccctctctctgcttgctatccctgacctttctttctttttgctccttttcaaaaaaaatattaatttcccccttctgtcgtcttctcgcagccgtatangtagatagtagggccgggccccccgggncccttttccccttttnaaaaggagaaaagggagggggaaaattttttcccccccccccaaaaaaaaagggggggcccccccttttttttttttaaaaaaaccccccggggggtttttttaaaaaaacccccccggccccgccc

SEQ ID NO: 416 - DNA, 639 bp, Homo sapiens
cgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcatt

SEQ ID NO: 417 - DNA, 516 bp, Homo sapiens
ttacaaaccattcattttatttcctgtattgggtttatacaaacttgcaagatacaaatgcagaactcactgggattcttcagtacctaaatctaaaaagaatgctgctgaaagggggaagcaaactctcacctgtttcagtcaggccatccctcctcctggggagggggctcattggctagaaagatgctaaggggatgctacagctgtttgtcccctgacagagattccatctatctaaccttcacccttcttctaaggccacttttatgctaaataaagacactgagataataaatttccttgtacagtttattgtctaatactagcaaatcaaattggccccaatatgtgcataaatagatatacgtgtgtgtgtgcgtttgtttgtatatatatatatttatataaagggtgtggaaaaccagaggggttttttatttttaaagcttccacgataaggggccacaaggggaatatgaatggttccccctggcggaaacagctgggtttttt

SEQ ID NO: 418 - DNA, 1219 bp, Homo sapiens
gagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggaggtatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaaaaaaaaaaaaaaa

SEQ ID NO: 419 - DNA, 551 bp, Homo sapiens
  modified_base (294)..(294): a, c, g, t, unknown, or other
  modified_base (531)..(531): a, c, g, t, unknown, or other
  modified_base (545)..(545): a, c, g, t, unknown, or other
ttttcttaccttcctatttttattaacccgggtcttctgcgcccaaagactcagcctcattcaggaccatattatgttcatacttctgctgcgtccaaggagtgttgacgaaaaagtggggccttggaggggtagaggccaagggacagtttcccctctgccctttgaagttcacgatcttccatgcaacaaaattgttttctgtgaaaagcaggaaatgaataacaacagcgtaggtgcgttggctatgtccggtggcatttcttcagaattttcattaatgacacctgattntggaggcattgtatatttttaaatacatccagatgttgtttcagttgcttcctctttggttctttttgcttttcgttgttgagcgtcacttaaattcgtgtcatttcatgttggtacaggtactccacttcaaatttcccaagaaattcagaagaattgtgaacaagttgctggtttcacaatactgcaagacactgcaagttattccaagttcctcagcaagtgtttacacattgngccaaggacagatntttcct

SEQ ID NO: 420 - DNA, 447 bp, Homo sapiens
ttttttttcagcttgtacacagatgctttattttggatgttaatatgtcaacattgtatgcaagattctcttacaatgaagttttccatatatcacaaaactcaatttagtcagggtaattgctgtattaatgtgaaaaccttacaataaaatgcagtattatgtatgtgtagtcagtttccatgcaagtatggctgctacatgttatgtctggcatttgtataacatactgaaagaaactcagaggaacaaaacagtttaaaggtgacttaagatgcctgacatgtttaagataaaaaatcttgcaaaaagcaacaaagcagttaactgaaggattcaaccagtaccaacccaaatatgtattatgtccaataagcccagacttatccacaatatattaccatttaggataatttaatgctcaagaaaaaatatgctttaaaaaat

SEQ ID NO: 421 - DNA, 1080 bp, Homo sapiens
ctcacgggaacgtcgagactggagcgcccgaactgagccaccttcgcggaccccgagagcggcggcgcgactcaccgcggaggcgcccggacgcgtcaatgtcccccagggcaaggcctgaaccaggtcgcgagggtctgtctcccgtctggggagctgaactgcccgagacactgtcgcagtcgcggggacttgtctggagcggcggggtctgagcccaagtcggaagccgccgccgccgccagcgtcccgtgcgcctgccgccccgggaccagccgcgaaacttcttctcgggacggagacagcgctcgccgcccgggccgaggcccagcccaataagaagcacctgatccacactctttctagccccagggatgctcaggaaagcagcctttctttagggctgtcatctgttctggggatctgttgctgtttcttgggcccacagaatacactccacacctcgggactccataatattggacaaggctggaaggcccatttggctcctgcagcctcttatgcaggaggacctcctgaggcttcgggcaggagctggtgcacacctggaggagagtgctggtgaatggcaggtgtgtgcctcagtgtccttgctgccagggtgtcagccctgcttcaccactggccgtttgtctctgtcccctccactggcctcttgaaagcacagaagacccctccggggtactttcctttcctttgggcttcccactcatgctattccctgctccctttttctacctggagacccccattcctcctcctcctttgctgccctcacctccacctgggccctcccagctcccgggagatggctgaaccccactccccacccgctagtcatcctcttcagcggtcctcccaagctgtcctcagcatggcagcctccacagcccctgggtgtcacccccggtttcgtgttgcctcggactccagacctgcccctcccaggctggcccagatggatcctctacagtgactaacccaaaccagcaccaggcagggacccaataaacctttgtgaatggagtaaaaaaaaaaaaaaaaaaaaaaaaaaaaaaa

SEQ ID NO: 422 - DNA, 450 bp, Homo sapiens
cataacttcattgtcaatttttattttttctgtgaaacacattgcttatatcccttattcattttttagttggattgtcacttttttctaattcatagaaattatttgttgattcattcctaaaagtgtgtatagttttacagattttattaagggccttcattcttagttatgtagcaaatattttccccgattcatttcatgtctttttttatgtgatgaaatacacataacataaaaattaccattttcatcattttaagtgtacagttcagtaacattaagtacattaatactgatgtgtaaccaccactcatcgccaaaacatcttcctcttcctaaccttcattgtatgtctttaaattcattctttgtgtcttatattatacaaaagttttacatttttatctattctaatttattaaccttttcctttatgacttctggctt

SEQ ID NO: 423 - DNA, 523 bp, Homo sapiens
ttttttttttccatttcacagctattccaatataaacttttatcagtcacattgaacaaaataactagaaatatttcatacatttaaaaaaagaataagaaattatttacaagttaagccgcaaacaattcaccaaaaactgagtaattaaggttacttaacaaacaattcttctgattagttggaaaattgtttcattactgttcacaaattcatacctgatttactctgtagacaatatagattaggcataggataaaatcctctgtatttggttcctcccaatcattggtcaaagtcatctgacaacagactatctgaggaaagtgtaaatacaaagtcacccaataaaacatgaataagttttgcaaagcacagtaaaggaaaaccagtttgttctgaacactttattgctaaaaggatgtaaagggtaagaggaaaaaggtgacgaaacactccttttgatatgcttgttggggagtcaggatgaacttccttggctagggatagaaggaagagatca

SEQ ID NO: 424 - DNA, 591 bp, Homo sapiens
tttttttttttttttttggcatttaattagattgcattttatttagataaatgaaaatttgccccaaacagaactaggaatcaaatattgtcttggactagaggtaattgctaagctggaagcttatattgaaaactaaaatttccagcccttgactatctgtagttccaaacatcaaaggaaaatattggaacaatttatctatgtacagagagaggcaactcatgggtaccataagcaaaataacctgagggggaacatttgatattacaagaagtggtgagagtttacaagtcttgcattgctttctattgtacatggctctgtagtaatgccaaaaataacaaaatgtaggcacttgctctgacttctgcagtttacattagattattatgtacttcataaattaacagcagctttagaattataaaacagtattatatttcatgctactgttggtgttcttcttgttaaaataatgttctcaacggacacagatacagagcttgtacagaagtaactctgggcacatccagatagtacaaaaagcagtcataaagcagctactcatggaatcgcaactgtgatggc

SEQ ID NO: 425 - DNA, 599 bp, Homo sapiens
  modified_base (415)..(415): a, c, g, t, unknown, or other
ttttttccttcaaaaaatagtttattctgcacatttcctagtaggctctctgcccaccgttccagggtagcagctactcataacttgtctttctctccaaaaccaagagggccttcccaacagaaaaaccttcagttcccaaagcagcatcgattcttcccctcaccccagcaaacctcggggtggaataatgaatcattcaccttctcccacccctcactgccccgccccaccttcatttgccaggactgtcactggctgatggtcagattttgtctttttcaacttggataccctcaagcatcccagcttttggaggcttccctgggcaacctcatgggcttccacattgaccaggcattacattcagcatccttggacaaaccacccatcagagcagtgggttgtggccagntccctccacccccgactccgccccaatggaagaaaccagaggatcacagggccccaggctgtgccgcctgcagagccaggagctgctgggtgcattgcaacgttctccctgagcaaatcggcatggtcaccacagtccagtcctcagtcaccgacagctctgcccctcggggtcagatcccacc

SEQ ID NO: 426 - DNA, 445 bp, Homo sapiens
aaccgagcagtttaaccaatctcttttaataaatccagcacattacagtggtataaatttatcttttttaacactccacataaaaacatgtgtcctctcttacatttaatcattagtagtctctaaaatggtaaaataaattgaatttacattagcaaatgaaagtgcaaatttgtacagctaggctcagcagcaaaagtgaagaataagaatgaaaggtgaaaagctggtggatgccatgcagagcgaggacttccataaaggtctgtgccctgcggccaaacacagtcaacacaccaccattttcttgttgctcttaaatgagcaaaaccaaatttcttttttatttaatgaaatattaaatctttatttccccctaacataatttgtgatcaagtaggacagaggtaagtcccaccatcactggggacagtagcaacacaca

SEQ ID NO: 427 - DNA, 3536 bp, Homo sapiens
atggggacgacggccccagggcccattcacctgctggagctatgtgaccagaagctcatggagtttctctgcaacatggataataaggacttggtgtggcttgaggagatccaagaggaggccgagcgcatgttcaccagagaattcagcaaagagccagagctgatgcccaaaacaccttctcagaagaaccgacggaagaagagacggatttcttatgttcaggatgaaaacagagatcccatcaggagaaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaacaacggaaataactcgtggccccacaatgacacggagattgccaacagcacacccaacccgaagcctgcagccagcagcccggaaacaccctctgcagggcagcaagaggccaagacggaccaagcagatggacccagagagccaccgcagagtgccaggaggaagcgcagctacaagcaggccgtgagtgagctggacgaggagcagcacctggaggatgaggagctgcagccccccaggagcaagaccccttcctcaccctgcccagccagcaaggtggtacggcccctccggacctttctgcacacagtgcagaggaaccagatgctcatgacccctacctcagccccacgcagcgtcatgaagtcctttattaagcgcaacactcccctgcgcatggaccccaaggagaaggagcggcagcgcctggagaatctgcggcggaaggaggaggccgagcagctgcgcaggcagaaggtggaggaggacaagcggcggcggctggaggaggtgaagctgaagcgtgaggaacgcctccgcaaggtgctgcaggcccgcgagcgggtggagcagatgaaggaggagaagaagaagcagattgagcagaagtttgctcagatcgacgagaagactgagaaggccaaggaggagcggctggcagaggagaaggccaagaaaaaggcggcggccaagaagatggaggaggtggaagcacgcaggaagcaggaagaggatgcacgtaggctcaggtggctgcagcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaagccgagagggagctgcaggagcgggagaaggccctgcggctgcagaaggagcagctgcagagggaactggaggagaagaagaagaaggaagagcagcagcgtctggctgagcggcagctgcaggaggagcaagagaagaaagccaaggaggcagcaggggccagcaaggccctgaatgtgactgtggacgtgcagtctccagcttgtacctcatctcccatcactccgcaagggcacaaggcccctccccagatcaacccccacaactacgggatggatctgaatagcgacgactccaccgatgatgaggcccatccccggaagcccatccccacctgggcccgaggcaccccgctcagccaggctatcattcaccagtactaccagccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctgtgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaagtgcaaatggacttgagagtatttatgtgctggtgaagtatgaggtctgagtagaaaagg

SEQ ID NO: 428 - DNA, 598 bp, Homo sapiens
aacaaagttattggttaggcctaagagacccttggtatatcacctgaaatcttggtggaggttgatattgatttattactctaagtttggtatgcagactgttactggtctaagaatgagataaggagtttgtgccacaacgtaaaataaactaagacactaagcacattgcttagttctactgacatttttcaatgaagaaagcagtacatggatttatattctggttcaggttccttgtgccctagaagaccattaaaaacagtttgtggacaggttactttcagtagtactgctatagttgacaactgccatatccatggctgtctatcaattctttgcatagtcttcttacatttaaagaaatttccattttatgagtttcagcttcccaaaatagaagtcaaatacaaatccccaatctcccttaaaaccagaatgcaggcatgtgacccagcctcctccaatcaaacacactcaaatgcaacttcaattcagaatagagcagtgtaaagaaacgaggttccattctcattgctgtaagacttttagtcgtgtcccagtggtataggtctagctcctgaatcagaaatggtat

SEQ ID NO: 429 - DNA, 457 bp, Homo sapiens
  modified_base (368)..(368): a, c, g, t, unknown, or other
  modified_base (431)..(432): a, c, g, t, unknown, or other
  modified_base (441)..(441): a, c, g, t, unknown, or other
cactagaaaaatgttgattattcattaataagtagataccagatcaagtaatcaaatacattaatgtaacttttctctgatactggtttgacaaatactatatttccttatttaactgacctgttttggaattcttctgaatacaggtcaaaattcaacattgtgaggaattttaagtagagcaagcacacttttttttttacaacaattacattaaactcaattatgctttacaaagatagcttgtttttcctcatagtgcgccaaaattctacatttccaagaccctgttttctaatagattctgtatttgcaacagtcatagaaattggtgatggtaaaaactaaaaaccacatttaattcaggncttacgttagccattccaggtgcaaattatattacagcattgatttgtaatttgtgaacacgnntgggtaatnacacagtgaaccttaa

SEQ ID NO: 430 - DNA, 1211 bp, Homo sapiens
gggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctgaaagcacttagcgggcgcgctgg

SEQ ID NO: 431 - DNA, 817 bp, Homo sapiens
agtcctgcgtccgggccccgaggcgcagcagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaa

SEQ ID NO: 432 - DNA, 3076 bp, Homo sapiens
gaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcaaagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaatacctggttttttttttgttttgtttttttgtacagacagggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattc

SEQ ID NO: 433 - DNA, 407 bp, Homo sapiens
tttttttttttttttttttttttttttttttttttttcctaggggaacatgttgcatttataaagaaatgtcacacgtacacacagaaaggtcatatcaaagcaggtaaaaattaagacaacatatttctccaaaaaccagtctgacatcttataataccagaaatatacacacacttcaaacctgggaaatcatcctatgaatctgctctgaccaatatggtagccactaatacctgaaatatggagtaaccaagtaacaaatttttaaatttaaaactgatactcatttcagttattggaaaacttttaagcacatttagaccaacatgggtatgtaaatttactttgcaaatttagattttatgaaatctaaacatggattaagtattatcagtaaaactttag

SEQ ID NO: 434 - DNA, 894 bp, Homo sapiens
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 435 - DNA, 6746 bp, Homo sapiens
ctgcagtgtttggtctcaccaagtttcccacaataaagagacatgagtcacctttcaagaccctttacccccaagaatgtggtcttcacacatgagaccaaggtctacaagtggtcaggagagagggggtctgctcagatgggggagtagtgcctgagctggcctcaagagggttaagtggccctgcactgaaaacctggacactgagttagggtagggctgggggaaaacttgggctttggagtcgtagggtctgggttcaaatccacagaccattcccttcctagctgtgtgttggtgggtaattcactggatctttctgagtcctggtttcctcatctgaggtaaaacgagtttgccggttggtctgagagctgttctaggcatggtggggagaccctgacaggcagaggcagccctgctctcaagcagttgatttacagctggggaaacaagacagccacaaatgcaatacctcaaactcaacttctcaccagaaagctccttttcctaattttcacagccagtccctcagcctcctgggccccaaatactagtaaaacctttgcctcctctctcttctttctttcttgtaatcatataggtacaaagtcctaccaattcttcctgaaatatgtttccttatcaaaaagtcctgcaaagccgtgcgtggttgctcatgcctataatcccagcactttggaggctgggaggatcgcttgagtccaggagttcgagaccagcctggacaacatatggagacccatctctaccaaaaattttaaaatcagcaggggtggtagtggcaagcacctgtggtctcatctacttgggaggctgaggtggggggattgttggagcctgggcggttgaggctgcagtgatctgtgattgcaccactgcactctagcctgagggacagagcaagaacttgtatcagaaaaaaaaaaaaaaagtcctgcggtactggacactgccattgcctatacgattcccactccctcatcctccctagcaggatatcaattttgttcgaagtgtcaatgaaggccaggtgcggtggctgatgcctgtaatcctaacactttgggaggccgaggcaggcggatcacctgaggtcaggagttcaagaccagcctggccaacatggtgaaaccctgtctctactaaaaacacacaaattagcagggcatggtggcgtgcacctgtaatcccagctactcaggaggctgagacaggagaatcacttgaacccggagtggaggttgcaatcagccaagatcacaccactgcacttcagcttgggtgacaagagtgaaactctgtctcaaaaaagaaaaacaaaacaaaaacaaacaacaacaacaaaaagcaaagtgtcagtgaaggtccagcaaaagactcccttcctattgccctttgcagccagggtcatcatgtgacacagttcagatcaatgagatggaggctgagggtccctgggaaagatgtttttcctatacaggtaccacctctttcagcttcactctttccattttccacgtgaacaggccttgtagcctggaggagctacagctgcctttttgagatgctgaggcaccctgtctgaagaaggccctcacatcactcaacttgactactgggtgagcccttggagaggcttcccagcctctgctcttcaagccgaagtaccacaggggacacgagtcccagagttacaggaccccagctatggttcatgtgtaaagggaaccattaggcaaccaggggaaatgatgaagaagatctacatttacaaatgtggaaagatgttcgtggtatattgttaaattaaaaagctgtttaaaaatagtttttgggtcaagtgagatgactcacttatacttttagtataagtatgtcccatgcaatatctggaacgtacttgtactaaggggtttctccctccatcggcacatcccaggcatcctggcagctgctggcctccagcaaccccacattctagttgtgtgggagtgggttgtggcatggaccctgtgggctaccactgccctgacctgcttcttcacacactggtatttgtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtaaggccttcccctcgggatcgatcctgatggcccacccagcctcgcactctcaggctggctgaacctggagcttggactctgtgggcacccaggtgcccctgcctccccccggccttctcccccgtcatggaggcctggccctcccctcagagccaggcttagtccggtgtgctgcccagcctgtcactggcctggccaaggaggagagacaggccagggattctggtcctaactctactggccacactgtgtggcctgagacccccctttccctcccaagcccctgcctccgcatctgcgtggtgaaggccattggcctcatcggtggatctgcgtttcctcgggcctacactgtctaggattgtgcggggctggtgagagaacaagatctcttccgtgttcaaggcagacttcctgccccctgcaccctgctctctcccaggccttgaggtcagtgtgagccccaagggcaagaacacttctggaagggagagtggatttggctgggccatctggatggaaggtaaaaaaagaaaatcccttgaaaggagattgagggaagtttctagacaaaccgacccccaaatctgtgttgctgggggaacagaggagaagagagagtctcgccctcctggctttctagaaggaacgtgagaacacgtgtttgtgctgagagtgggtcagagcggctccagggcaaagcatgtggacaggtatcctggccccctgcaaggcccagctcctgtcctaggccctggtcacctcctggactcccaccagccaggagaacgggctttccctctccttccgcctgcggaggggaagctgaagtctggtcttcctcaggtctggtcttctctcgtctgagccctgagtactacgacctggcaagagcccacctgcgtgatgaggagaaatcctgcccgtgcctggcccaggagggcccccaggtacgtgttggctctctgctcacctgccacagtccctctcctttccctcctccctggtggctcctggggtgaggtctggagctctctaatggtcaggaggtgggagtggaggctgggctgtttctgacgatgctggttttgttgaattcatgtctggccaggagggctacaggtatctggcagactcctccaggaggatcctctggggtctcaccctccaaggagcctggggctgcagaacccaaataggcagactcccctgggagttcctcaataggagaggggcaagtgcagggctgggaaagtactggggttgtgggaggctgtttctggggtgtctcagagcctctaagacaagcaaaagggtgggtaggggccaggcagccagttcaggccttcagtgtatccacgctctgggaagagatcacggacattcctgccggcctcagaaacacaaagggcccctttcctgggcactttcacgcgctcccagagtgtctgagagaccatcataagggctttctttcctgacagggtgacctgttgaccaaaacacaggagctgggccgtgactacaggacctgtctgacgatagtccaaaaactgaagaagatggtggataagcccacccaggtgaggccaaggggctacagagcctcctgtctgctgctcaatggaggggccagcctgtgaccaggtcggggatcggggagcccgggggcaccttgcacagtgatcctgggggagggcttcctagaagggaatctgtgagtccccgtgtgtctgtggatgaatttcagagaacttgtgaaattgtgactctctggaactgtgtaagtcagacggcagagtatacatggttttcatcatgtatcctcaaagagggcttgtcccagagaagttaggaatcttcccctaaagccctaacatttgtgtccaaggcagagtttgagaagctagttccccaagaggcctgggtcaggactgataaatcccagatctgctacttccaagctgcatggccttgggcaagtcacttccactttctgagcccctgttatcttatctttgaaatgtgatggataatagtccctatcttgcaagttgtcaaacccttttttttttttttccttgagataggatcttactctgagacccaggctggagtgcactggtgtgatcttggctcactgcaacctctgcctccctggcccaagcaattctcctgtctaagcctcctgagtacctggggctccaggtgtgcgccaccatgcccagctaatttttgtacttttgtagaaacagggtctcactgtgttgcccaggctggtctccaacttctgagctgaagcaatccacctgccttggcctcccaaagtgtgggattataggcatgagccactgcacctggctgctgaagctttttaaaagagctgagggctgggatgtgcttagctccacgtccagcactgagtaaatgcttaacgaatgactgtgttactaccaagaattattgtttcactctccctccttccctctcctctgctgccccaaactactcagcatcctggcactgcaggctcgcacttagccctggatacccagattcatcctcctcccctgggatggcatagaagagactttaaaaccaaatgagccaagactccaagctctgaccacacctcccacccccaccagtcttctctatgcaccccctctatatctggagcccccagccaggttctggaccaaggtagctacatggcagagcatttaatgtgtgcctggcagccatgggcaccattctccacacagaaggcagggacaggtgcacaaggggctgagaccccagcagggctaactgtccttgtctcaggagccctacctggccagtcttgggccaggccttggggactgggagtaggggctgacccgtctgtacagtctctggccccatggcaccaggtgccagctcctcgcacccagtactcccattgctagggctgctggaacctgcagggttggcagagctgggcaggactcaccctataaccatgtccactgtggtgctgctgctgcagagaagtgtttccaatgctgcgacccgggtgtgtaggacggggaggtcacgatggcgcgacgtctgcagaaatttcatgaggaggtatcagtctagagttatccagggcctcgtggccggagaaactgcccagcagatctgtgaggacctcaggttgtgtataccttctacaggtgagtgcagaggtgacagcagggatacctcctgagggttggagacagcttcccccaggatatatcaaagctgcctccttactcccccatctcccagcatgggaaagtgtggagaattgagcagatggactttagctagaaatgtttgagaaatactgattagagcttgggcttcagacacaggtggttgtggagtaaaatctggtctccatctctccctggctgtgtgaccttaagcaaataacttgacctctctgagcttcagtttcttcatctgtgaaggagagatagcaatcctgatttttgagattggaatgagaattgaaggaggtcaccgtgtgtgtggacctgaccctggggaaatgtcctcagactgaggctattcaaggtcatcagaccctcagtcaaactccaacccagcccagcacatggcccctggggtcgggagctggggccatatcctcccccacaatcctgggccctgagatctgggctagggaacccttcaggcaggggagcatgaggcctttccctccatggctgcccaggctgtgctgagagaacagatctcggctgtaggaaacggggccagaaaggggcctcggtgattggctctggcagctcagctggcacttgccaatagctctgggattttatgctggcagatcgggggtccccaccatttcctgtcattggagcttgtggcttttctattcaaggccccacagcctgctcaggctgccgactggcttccaggatgtgcctctgggtgtgttcagtagggtcaggtggctctgggaccttaagcaagtaacattctgagtgcctgcttctccttgaggacccaccacatctgcccacagctagctgttctctccgctccaggtcccctctgagccctctcaccttgtcctgtggaagaagcacaggctcctgtcctcagatcccgggaacgtcagcaacctctgccggctcctcgcttcctcgatccagaatccactctccagtctccctcccctgactccctctgctgtcctcccctctcaggagaataaagtgtcaagcaagattttagccgcagctgcttcttctttggtggatttgaggggtgggtgtcagtggcatgctggggtgagctgtgtagtccttcaataaatgtctgtcgtgtgtcccatacactgttgtagatgttatggatttagtggtgaacgagacaaccttaacagcattcacacagttagtcgtgaaatgcttactgagcactcaccacagccatgca

SEQ ID NO: 436 - DNA, 394 bp, Homo sapiens
tttttttttttcttgattccttaattttattctttcgtgtgcctggtgagatggcattcaggaaacaggatttcaaaatcccggtctctcttttctcctcacgttttctctctgttgttacttgccgtgttcacagagctggtcccttgacccaagagagagcctgtgaaatctgcagacactttctgaagttggggacaacagcttccagccagaggaacgcaaggaaccaagtgcaggggctggtgggaggagagtttcctgagcagactttctctgaggaggtgattgattactcggtagtctttcttagaacagcctcttcttttgaaccttattccaaacatatccgcagtgccgtcagttgccagtgtcatactaaagagcctcgtgc

SEQ ID NO: 437 - DNA, 514 bp, Homo sapiens
agcgctcagctcctgcgccccgaccccgccatggccccccggcccctcctgctgctgctgctgctcctcgggggctccgccgcgcgccccgcgccccccagggcccggcgacactcagacgggacgttcaccagcgagctcagccgcctgcgggagggcgcgcggctccagcggctgctacagggcctggtggggaagcgcagcgagcaggacgcagagaacagcatggcctggaccaggctcagcgcgggtctgctctgcccgtcagggtccaacatgcccatcctgcaggcctggatgcccctggacgggacctggtctccctggctgccccctgggcctatggtttcagaaccagctggcgctgctgcagaaggaaccttgcggcccagatgaggaaggaaccccctcaccacctgcccggcccaggagcgcagctgcatttggggtggggggcaggatgggggagagggggaggggtggtacttggcaccaataaaggaggaatcagacc

SEQ ID NO: 438 - DNA, 554 bp, Homo sapiens
  modified_base (477)..(477): a, c, g, t, unknown, or other
  modified_base (536)..(536): a, c, g, t, unknown, or other
  modified_base (554)..(554): a, c, g, t, unknown, or other
aagtaaagacggggtttcactgtgtcggccaggctggtctcgacctcctgatctcaaatgatccgcccgcctcggctttctgaagtgctgggattacaggagtgaaccgttgtgcctggtacaactgttatcttctttaagaaatgatgggaggccttttttccaggtatcatagtcaatatcagcacccagtttaatgtaccaacagggatttctggaccaaaatgactctttatgctttgtcacatcttgagtgagcatgatcatagactccatggagcacatttacaactgggaacacaaagtctgttcacttttcccaggcctgggccattacctgaagattaggacacccaatgatacattctactttaattttacacttcagacttctaggagtcttgcatctgttttccagcagccacaaaagacattctctaattacttctgaatgaaaaacagagacttttaatttcntgcaaagacatgcatgcactacatacactttaagaccctggggtggctcaatttctggnaaaactggacttttcctn

SEQ ID NO: 439 - DNA, 1418 bp, Homo sapiens
acgagggcgatggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagccttcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccaggtcagtaaccagccctgcagcacagcctccttgactcccccagtctccaaccctggccttgacccgggttgctttttgcctccctctactgcagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagtaaaaaaaaaaa

SEQ ID NO: 440 - DNA, 826 bp, Homo sapiens
ggtcggaatgaactgatcgcccgctacatcaagctgagaacggggaagacccgaactcgaaaacaggtttctagtcacatccaggtttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctccccgagggtacgagccccgaacaaaagacgcaaaaaagagagagagcgaacaggggaagaacaacagccaaagaagaggcaagacacagagagaatgagaaacgacaagaaggaaacagagaacaaaacaaaggaggaagacgaacaggagagaaaagaaagaggaagaaacaaagagaaagagaaaaaaaagaacaaaaaaagaacaagagcaggagagcagcaagaaagaagagaagacgagaaacacgggcaagacaagaaaaaagggagagcgaggcaaaggagagaacacgacagaaacgacgaaagacaagaggaccaagagacagaggcgaagaagcgaagagcgaaaagagcgaacggagaagagagaagagggaaagaaaaacaagaaagagacagacgagaagcgaagaggaaggacgaagcagaagagaagaagacgaaaaagaagcaaaggagagcgc

SEQ ID NO: 441 - DNA, 2003 bp, Homo sapiens
tttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgctttcaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaataattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctataggtgagaccagacacaaagtaaatgacctaactcaattacaaataacaaggacccctctgcaatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 442 - DNA, 2201 bp, Homo sapiens
atggtttccagatgtagctgcctgggggtccagtgtctgctgctctcgcttcttctcctcgcagcctgggaggtggggagcggccagctccactactcagtctacgaggaggccagacacggcaccttcgtgggccgcatcgcgcaggacctggggctggagctggcggagctggtgcagcgcctgttccgggtggcgtccaaaagacacggggaccttctggaggtaaatctgcagaatggcattttgtttgtgaattctcggattgaccgcgaggagctgtgcgggcggagcgtggagtgcagcatccacctggaggtgatcgtggacaggccgctgcaggttttccatgtggacgtggaagtgaaggacattaacgacaacccgcccaggttctccgtaacagaacaaaagctctcaatacctgaatccagactgcttgactctcgatttccactagaaggcgcatctgatgcggatgttggagagaacgcattgcttacttacaaactcagtccaaatgagtattttgttcttgatattataaacaaaaaagacaaagacaaattcccagtgcttgttctgcggaagctgctggatcgtgaagaaaatcctcagctaaagttgttgttgacagcaactgatggaggcaaacctgaatttaccggatctgtttctctgctgatcctggtgttagatgccaatgataacgcccctatctttgacagaccggtttatgaagttaagatgtatgaaaatcaagtgaaccaaacattagtaatacggctcaacgcttctgattcggatgaaggaataaacaaggaaatgatgtattcatttagctctttggtcccacccacgataagaaggaaattttggataaacgaaaggacgggagaaataaaagtaaatgatgctattgactttgaggacagtaacacttatgaaattcatgtagatgttacagataagggaaacccacctatggttggtcactgcacggtcctagtggaactactggatgaaaatgataattcacctgaggtgattgtcacttctctgtctctcccagtgaaagaagatgctcaagtgggcaccgtcattgccctaatcagcgtttctgaccatgattcaggagccaacggacaggtcacctgctctctgacgcctcacgttccgttcaagctggtgtccacctacaagaattactactcattggtgctggacagcgctctggaccgcgagagggtgtcggcctatgagctggtggtgaccgcgcgggacgggggctcgcctccgctgtgggccacggccagggtgtctgtggaggtggccgacgtgaacgacaacgcgcctgcgttcgcgcagtccgagtacacggtgttcgtgaaggagaacaacccgccaggctgccacatcttcacggtgtctgcgtgggacgcggacgcgcaggagaacgccctggtgtcctactcgctggtggagcggcggttgggcgagcgctcgctgtcgagctacgtgtcggtgcacgcggagagcggcaaggtgtacgcgctgcagccgctggaccacgaggagctggagctgctacagttccagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctg

SEQ ID NO: 443 - DNA, 448 bp, Homo sapiens
  modified_base (138)..(138): a, c, g, t, unknown, or other
  modified_base (356)..(356): a, c, g, t, unknown, or other
gttagtatggttttatattttatcaaaataacagaaaagcaaatttttaaatactaacctcaatccccttaactcttaagattataatgaaatatgaaaactcagcttctaaactgacatagtattaagttacagtanacatttacatttctatttttcaaatgtaatgtcttttacaattagactgatttctattaacgattccttcaaattaatgagaaaatttgcatmtgcttatattacttatcctgaaatctaatagaaactcagaagcattcaatatgatcaagacttaaaagtaagaatgaactaaagabtaaaatacttggatgcatttataccaggaaaatatatcngctaytccacccaaamtttcactgaataatataaagcagaagactathcaaaatgaggttagctctactaggtaccttaagggtctaattag

SEQ ID NO: 444 - DNA, 4539 bp, Homo sapiens
cggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctacgacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggaggtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctag

SEQ ID NO: 445 - DNA, 455 bp, Homo sapiens
aactttaagaagcgaacttttgctattgcacatacctgctgcctccaaagcgccacgccactgattgttttccttgtttcgtggaaggaagacaaaacttgttccagctcaacaaggcttcctatatcttttgccccatcagtttgtaattgtccccaaattccaatatctgattcatcaatagttgattttccttctaatttcagaaacacctcattcaaagttgttatggaaacaccataatcctcaatgccttggttagaacatctatcaagatccctgttaagttctggaaatttgtttgtcctttccaaaggcaaaatatatacaagttcttcttcactttgagctgtcaatttggcatcagagatgtgctgcttaaccagtgatgttatactctctggatcacacctttcattcagatgcaaacttaaatggtagcctatgccccattt

SEQ ID NO: 446 - DNA, 591 bp, Homo sapiens
  modified_base (446)..(446): a, c, g, t, unknown, or other
  modified_base (462)..(462): a, c, g, t, unknown, or other
  modified_base (525)..(525): a, c, g, t, unknown, or other
  modified_base (550)..(551): a, c, g, t, unknown, or other
  modified_base (588)..(588): a, c, g, t, unknown, or other
ggccctccttacactttggagactcttcccttatgtgaaattttataaagaatgaaatctgaaggaggtgggagagggtatgtccgggcccccatctccttggtgttcccttcttatgccataatttctccttggcctcagaggcacctttactgcaggtgagggctctttcaagcccagatggagcctcaatggcctgggtgacacccaaggtctctctagactcttatgttctacctgtctttctgaaagccccatggagtggggaggacagccatgacatagtaagaaaaggagaattccctagcacctgactgaaaaaaataactgggaagagagacagtgacaatacacaatacacatgacctcacgtacatggagcacggtgaccatgaactgtaacattaagtatcacctcagaagcattccaaacctgggtgactgancgccccagtagatgangaggagcaggaaggcttgtgtggatgttcacacaccggcccaacttccccaagaagataagcnctcatgggaaaatcagagagactgnngaactcaaatccctgggattcccggaatgggcacctnttg

SEQ ID NO: 447 - DNA, 552 bp, Homo sapiens
gttttaaagttttatttgcttacaaaagaaaatggaaataggtttgcgaaaacttatctgcatgtacaaagtaatccccgtagataaggagaggcaacccctggaacaaactgctggataaatcgttcattaaaattatatctctttgcatcagagctggtggaaaatcattatttcacatgagttaaaaccactgaaaaactaaatctgtttcttaaactaccaaatttcagaaaagcttaaatccaaatgctgatttttggatacacatgaaaccagttaccaagtgatctcagagttggacagatcaattaaacaagaggtagtttctccaatattgtccctttttttcttatcagcaaggttattcctatagcaagtaggagtaagtgacatattctttgaacctctttgaattcttttcctgctagggacatatttccctcaaacacaatcatatctgtttgttcattttaggacttgagagagaagattccagagttcaatttatttttcccaattcctctttgagctctcttctctggaaaaaca

SEQ ID NO: 448 - DNA, 558 bp, Homo sapiens
tttattttttttgaaatgatttattacttttagaaaacagtataaacttacaaactataaattaagatataagtatatttctgccaaagtaagtcaagaaaaatgcacttcagaatcagcttttattacaggcaatgtattgtaaactcgaacatccagaatctgagttacacttattatttttaacattttactcaataaaaatctgatatactgggtccaagtgatgacacattccaaattaatgtaactttcttgcagcttaaataaacaaatttagatcaccaagtgaaatcaaagccaagtgtatttgcacaactcaagaatgatgtgaatggattagaatctctcatagtgcatacttcgccatttatacacaaactttgagagtcttctgagtgacatggtatttaactttgtttccaagggccaaatactaaaatgtatagaatatcctactctatactcactattaaatgtcatggactaggaaatctgagacacagaataagaagcaactgattacacaccctagtcatttaagttggaagagttctc

SEQ ID NO: 449 - DNA, 776 bp, Homo sapiens
  modified_base (502)..(502): a, c, g, t, unknown, or other
  modified_base (549)..(549): a, c, g, t, unknown, or other
  modified_base (554)..(554): a, c, g, t, unknown, or other
  modified_base (639)..(639): a, c, g, t, unknown, or other
  modified_base (666)..(666): a, c, g, t, unknown, or other
  modified_base (706)..(706): a, c, g, t, unknown, or other
taacttatttataggcctttcctgatgccaaataagggcaatgatcagcttccccattcctggagccaggacctgccacatcatttgcagtgcaaaatgcaaatgagagccccttgttcaaagagcaagataaaagtgccatcctaggcgctcaaaatacaaaggttcctcctttcttctatggtctgtcaattggtcaaggcattttaatttgctacttaatgtcatgcttgctgggcactggaatactcatgcggtgagtgtaggatcccacgggtatctggaggctcgccctgcaatttagcatgtgcaaggagctccccacctctgccagcccaggatgggcgtgtgatgccctggctggggtgagtgaggttgagccaggtatctctgtgtctcatgggcccaaccgacacgggagagaagacaatccccatggggactgcaacctttgaactgggacacatgaggcctctgggttagggtcggggagaggctcgtncccctgcccagccacccactgcatgtgcccttgtgctgtcagcttgnggcanaacgcgggtgccatgtctgggcctgtgagccctgtcctgacctggcatgcacccatgccctcctggggtgctgggtagcagcagntactgtgtagggtggaacagggcaagnccagttgggcccaggcagcaggcttgagcttgcagctganaaggaccatgggagccaagctctgagcccagcagatgctcatcatcccattgacttacctcgtgccgaat

SEQ ID NO: 450 - DNA, 1617 bp, Homo sapiens
cagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagagcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctgtcctctcctggcctccagtctcccctgctgtcccaggtagagctggggatgaatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcactctttgcaattgctaaataaagcagatttataataca

SEQ ID NO: 451 - DNA, 433 bp, Homo sapiens
gcgagagaaaaccacgtgcaccaaactttaggggaggaaaaatgggaacgtggggagaagacgtgaggcggcagatctgaaaaagatggtcattccggactcctgacgccgccagtcccgcggtgagacgtgagcgccattggcgtccgtggcctctgtttccgtggcaacctagtaaccattaattttcaattaaaggagacaaaaagctcgatgacagctccaggtctgctgaagatgtcaagaatctgtattaatatacagcaagagagcataattgtgtgtccatcttccagagcagcgaaaaatggagggataattaccagctcgaaagccactctgtaatttagttcttactgtcaccacagccctacacattagcataaattaaaagcagagtttattgttatcaaagtgcaaaaaaaaaaaaaag

SEQ ID NO: 452 - DNA, 753 bp, Homo sapiens
tagtggccaaatagcacatcctccaacgttaaaagacagtggatcatgaaaagtgctgtttgtcctttgagaaagaaataatgtttgagcgcagagtaaaataaggctccttcatgtggcgtatgggccatagcctataatggttagaacctcctattttaatggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtcacttggagagggacgaagaaagggtctgataaacacagaggttttaaacagtccctaccattggcctgcatcatgacaaagttacaaattcaagggagatataaaatctagatcaattaattcttaataggctttatcgtttatgcttaatccctctctcccccttctttttgtctcaagattatattataataatgttctctgggtaggtgttgaaaaatgagcctgtaatcctcaagctgacacgtaatttgaactggtgcagaacaaacaaaaaaggattacgggaatttatttattaggattctcccaaatgattttcatccaatttaaaatcattccaatatctggcaggtaccttcaggtttagggcttacttgggcagcctcagtggacatccagggggctcctg

SEQ ID NO: 453 - DNA, 618 bp, Homo sapiens
  modified_base (519)..(519): a, c, g, t, unknown, or other
cagtaagatcttgtatcatgtatttattccaaaaaaatcggtcatcaacctagaaaaggtgcaggaacaatagttcagaaacacattatttcagttttcctacaaaagccaaaacaggccatcacttcttcccaagggcaaaccctgctctacgagctgtgagtggtaccttctgccagaggggccgaccgtccctctccccagtgctctgcctctgcacggaattggtcaggtcataggtcaagctataataaaaggattctgagtccatgaacatcttcagcaactcttcaagtaatctcctctccaacttctccttctctttactttccttaactttctttttattaggagcagacacattggatttaatatgcgtaaaggtcttcagtagaaactttgagtcatcaggagatggtatgatcttctctggtttgttaataccaaaatgatgcttcttacagagctctagctcaagatcctgaggttccatttcagaaagtgagagcacagcaattntggtaactttacagacctcatggtctcctggagtttgcccaccaatgctttctgccggattagaataagccaccatgggagatctgaatgaagttgaat

SEQ ID NO: 454 - DNA, 1047 bp, Homo sapiens
ctgtgagtgacacacgctgagtggggtgaagggaaatgctggtgaatttcattttgaggtgtgggttgctgttagtcactctgtctcttgccattgccaagcacaagcaatcttccttcaccaaaagttgttacccaaggggaacattgtcccaagctgttgacgctctctatatcaaagcagcatggctcaaagcaacgattccagaagaccgcataaaaaatatacgattattaaaaaagaaaacaaaaaagcagtttatgaaaaactgtcaatttcaagaacagcttctgtccttcttcatggaagacgtttttggtcaactgcaattgcaaggctgcaagaaaatacgctttgtggaggactttcatagccttaggcagaaattgagccactgtatttcctgtgcttcatcagctagagagatgaaatccattaccaggatgaaaagaatattttataggattggaaacaaaggaatctacaaagccatcagtgaactggatattcttctttcctggattaaaaaattattggaaagcagtcagtaaaccaaagccaagtacattgattttacagttattttgaaatacaataagaactgctagaaatatgtttataacagtctatttcttttaaaaactttttaacataatactgacggcatgttaggtgattcagaatagacaagaaggatttagtaaattaacgttttggatataagttgtcactaatttgcacattttctgtgttttcaaataatgtttccattctgaacatgttttgtcattcacaagtacattgtgtcaacttaatttaaagtatgtaacctgaattaactcgtgtaatatttgtgtgtggagtgggatgtggggggtggagggggaatgacagatttctggaatgcaatgtaatgttactgagacttaaatagatgttatgtatatgattgtctgtttaagtgtttgaaaattgttaattatgcccagtgtgaacttagtacttaacacattttgattttaattaaataaattgggtttccttctc

SEQ ID NO: 455 - DNA, 455 bp, Homo sapiens
  modified_base (454)..(454): a, c, g, t, unknown, or other
ggtccgggttagctttattggagcctcctagcaggccaggtgtttcaggcaccagtagtgctgcaggcacgggggcctgtggtgtggccagctgcaggtgatctcggtggtggactccgaagtgtactccagagaggtcccggaatggcaggggaccagctcgggcactgaggcgctgctggcaggctgtttcgacgattccttctggcgctgtccgctggtcttgggggctgcgtcctccggcttgccagaggacttgctggggggctgcgtggggatgttgctgctgctgggagactggaccatgggtgggaccgggctggaggtgacgttgggtggctgcaggggccccgaggacgggagggctgactgggaggggccggaggaagtaccaggcggctgggtgtgttgccgagaccagtgggagctgccctgtgcccgacgctggccctgng

SEQ ID NO: 456 - DNA, 1553 bp, Homo sapiens
ctacatcaaaactcctcggaagatgttccggcacacggacagcctctttcccatcctactgcagacgttatcggatgaatcggatgaggtgatcctgaaggacctggaggtgctggcagaaatcgcttcctcccccgcaggccagacggatgacccaggccccctcgatggccctgacctccaggccagccactcagagctccaggtgcccacccctggcagagccggcctactgaacacctctggtaccaaaggcttagaatgttctccttcaactcccaccatgaattcttacttttataagttcatgatcaaccttctcaagagattcagcagcgaatggaagctcctggaggtcagaggccctttcatcatcaggcagctgtgcctcctgctgaatgcggagaacatcttccactcaatggcagacatcctgctgcgggaggaggacctcaagttcgcctcgaccatggtccacgccctcaacaccatcctgctgacctccacagagctcttccagctaaggaaccagctgaaggacctgaagaccctggagagccagaacctgttctgctgcctgtaccgctcctggtgccacaacccagtcaccacggtgtccctctgcttcctcacccagaactaccggcacgcctatgacctcatccagaagtttggggacctggaggtcaccgtggacttcctcgcagaggtggacaagctggtgcagctgattgagtgccccatcttcacatatctgcgcctgcagctgctggacgtgaagaacaacccctacctgatcaaggccctctacggcctgctcatgctcctgcctcagagcagcgccttccagctgctctcgcaccggctccagtgcgtgcccaaccctgagctgctgcagaccgaagacagtctaaaggcagcccccaagtcccagaaagctgactcccctagcatcgactacgcagagctgctgcagcactttgagaaggtccagaacaagcacctggaagtgcggcaccagcggagcgggcgtggggaccacctggaccggagggttgtcctctgacaggcctggcacggaggagggcccaccgagtggtcccatgaaacactaagggtcgtcacgccctcccgaggagctcaaggacctgcctgtcaggaccagggctgggcctgccaacccagggcagtgttggggccggaggctgctgtgtctgcccaagctcctctcagagtccagtccccaggcctccagcgctgtcagctgcaccctggcattctcacagagctggctgcccacccagtggggggctatagcctcagagaccactcatcctctggaatcaacctctttctaataccctcttggaaaaagagcttgcccctcctccagcacactagagctctggccttgtgtgtatatgtatacatacgtgaacacatgcctgtgtgtgtgtgtgtgtgtgtgtacttgtatgcacgtaggcaccagcacaaagatctgaatgatgcaccccacccccaccccaataaagaaataacagaaaaccctc

SEQ ID NO: 457 - DNA, 2384 bp, Homo sapiens
gccatggccgccggccccgcgccgccccccggccgcccccgggcgcagatgccgcatctgaggaaggtgcgaggcggatggagcgggtggtcgtgagcatgcaggaccccgaccagggcgtgaagatgcggagccagcgcctgctggtcaccgtcattccccacgcggtgacaggcagcgacgtcgtgcagtggttggcccagaagttctgcgtctcggaggaggaggccctgcacctgggcgccgtcctggtgcagcatggctacatctacccgctgcgcgacccccgtagcctcatgctccggccagacgagacgccctacaggttccagaccccgtacttctggacaagtaccctgaggccggctgcagagctggactatgccatctacctggccaagaagaacatccgaaaacgggggaccctggtggattatgagaaggactgctatgaccggctacacaagaagatcaaccacgcatgggacctggtgctgatgcaggcgagggagcagctgagggcagccaagcagcgcagcaagggggacaggctggtcattgcgtgccaggagcagacctactggctggtgaacaggcccccgcccggggcccccgatgtgctggagcagggtccagggcggggatcctgcgctgccagccgtgtgctcatgaccaagagtgcagatttccataagcgggagatcgagtacttcaggaaagcgctgggcaggacccgagtgaagtcctccgtctgccttgaggcgtacctgagtttctgcggccagcgtggaccccacgatcccctcgtgtcggggtgcctgcccagcaatccctggatctcagacaatgacgcctactgggtcatgaatgcccccacggtggctgcccccacgaagctccgtgtggagagatggggcttcagcttccgggagctcctggaggaccccgtggggcgggcccacttcatggactttctgggaaaggagttcagtggagaaaacctcagcttctgggaggcatgtgaggagcttcgatatggagcgcaggcccaggtccccaccctggtggatgccgtgtacgagcagttcctggcccccggagctgcccactgggtcaacatcgacagccggaccatggagcagaccctggaggggctgcgccagccccaccgctatgtcctggatgacgcccagctgcacatatacatgctcatgaagaaggactcctacccaaggttcctgaagtctgacatgtacaaggccctcctggcagaggctgggatcccgctggagatgaagagacgcgtgttcccgtttacgtggaggccacggcactcgagccccagccctgcactccttcccacccctgtggagcccacagcggcttgtggccctgggggtggagatggggtggcctagtggacctggcccatctgccactctagtccctgcagctcaacgtcctgcgtgaatgcagcagccacccccgtcttggcccaggtcctgggggctgctgaacccagcaccagtgtccccttgtgcccagggggcccagtcttctgtggggtgcacagcctccctccctccagcaagccctccctgcccagaaggaatgggtccaggtgtggattcccagggagggggttcattggctcagcttgggtcagggcagagcctgttacctgaagagaggtgagaccaaggccacagggagctccaccttctctggtcttcagtccagcactgggtgcccatccccatctctaaaaccagtaaatcagccagcgaatacccggaagcaagatgcacaggcgggcggcttcccacacacccgtcacaagacgcggacatgcaggtctcggcgcgagctctgccccgtccaagagcctctccgctgtcgcccagtgtgagcctggaagaggacccaagagagtgccgtgctgaggctgcctcgaggtcactgccttccggagctgcgcctattcctccctcgccaaacgcgttccagaatttgtccacaggtgcgccggcacctgctttcccacctcgaggccgcggcctcccccccgatttatagacaactctgacattgtcaccccactgacgaggcccgattccatagggtggatccttgccaggcgtccctgatcctccctgcccaagtcttccttcgtgagctggccttgctccccatcccccaagtgcctcaccagtcccccagactgggtgaaggtacagctggctcctttcgggggtgcagcttcaactctctcggcggtagggcggtgccatccccacccatagggctggctcacatccagtcactcccaacagcgtccagcacacaaataaaagacccttgggccctggctctgagaaaaaaaa

SEQ ID NO: 458 - DNA, 872 bp, Homo sapiens
  modified_base (481)..(481): a, c, g, t, unknown, or other
  modified_base (624)..(624): a, c, g, t, unknown, or other
  modified_base (654)..(656): a, c, g, t, unknown, or other
  modified_base (659)..(660): a, c, g, t, unknown, or other
  modified_base (664)..(665): a, c, g, t, unknown, or other
  modified_base (671)..(671): a, c, g, t, unknown, or other
  modified_base (675)..(675): a, c, g, t, unknown, or other
  modified_base (756)..(756): a, c, g, t, unknown, or other
tttaaagttggaaataattttattagttttttaatgcataaatccaaacatatatttgtactgaatattttattagctaatacagtaccattttaaaagttctaccaacttatttaaaatatttcctgtaaaaacatcatccaaaatatactttgttaatttttatgaatgttaggtgttatgtctcttttctttgacgctctccttttttatcctgtgcttacaccaaaaacaaattatttgaaaatgctaaaataaaatgtggcatgttttcttagctgttttgtattctgttataagatattttacaactatgaaagttgaaaaataactttattggttttgctgcatatagctgcctgtctactataagagaactaatccataaaattaaggcattttgttatttcaagtgtagaggggcaagacataagggaattataaaaacccaagatgactcatttaaagtagatgcacattnaatactatagatctggcatatttcatatttataaagcagacaaaagaatggttatctgtgccattgggcagagtatcttcaagataactaccacttttccaagccactattgtgggggtaggtttattagggggggggacttnggaaacctgactttcctcacccccttcccnnnttnnttgnngggctnaaantaaaataattaaagaagaagaaagaagaaaaaaaaaaaaaaaaaaaaaaaaaaaaaaaaaaaaaaaaaaacaacatcatcntttcctgtgaaacacaacacacaacacacaccaacacatcacacacacacacacagcagcaacgcaccacacccacacaccacacacacacagcacacatcacacaacagcacaca

SEQ ID NO: 459 - DNA, 598 bp, Homo sapiens
ttttttttttttttttttttccactttagtaagttgtttaatatgagcaacttgattactacaagatacatttggcaaataatttatatatatattatttttgggatttttggagtcgcgttctttcatattttaatttcctgcaattaaggaataatgtcctctcaacagaaagctattttaacttacttctacacacccacaaaaacttattctccatacatcctattaaattttggcaaatatcaattttcaaaactattttcatgctctgaatattactatatgaagcttttattttttagaaattcacataattcctgacttatttttataagttactgttggttactgatgacttttctccttattgtagaatttcaagtacagtagtctccctttatgcacagtttcactttccacggtttccgctttctatggtcaaccaaggtggagtcccacagaatctggtttgccattatcattcttacttggttgcacaagtggagcaaatgaaacagcaaggatatttttactttcccaagtgttctgtccagttcgcataatctgtgttaactgatcctctataggcatgact

SEQ ID NO: 460 - DNA, 403 bp, Homo sapiens
ttcagttttcaagggttatttattaaaccccttggttctgaccccaagctaagtgggactcagcatcagaccctgcactcagagagccccctgacttggggaagacagagtcagagaaaggcagccccagtgtggccagggctcagctggaaggaaggacaaggggctgggagaacccagagttcaagagatctgggaaacagggaacggcattccagacggagggcacaccttgggcatgggtaaggaaagcccatcgtgtgttctaggaagcatggatggatgaaacggggtcccagccgctatggacagccccgagtttcacctgtaaaaggcaggattatttgtttttaattttaattttaatttttttgagacagtcttgctctgtcgcccaggctag

SEQ ID NO: 461 - DNA, 544 bp, Homo sapiens
ttatgtatttcaaaatgtttattaaatgaaaacggagagtttagagaggggggctgctaggcagactgggttgcacctgattacctggatgataataaactgcacaaaacctcggtcaaattaatattgaaactgccttttgcttgggctcgtttcccttgcggaagaaggatgaccaagaagatgaacaggaaagaaatgagaaaccgaggcctttgcttagtagctaaaggctaccttctgtaacatgaaatagtctacaagtggccttgaactctgccgtgattcagtgacagagttccctcatgtcttctacccaggttgaagtccagcaaaattgcgactgtcctctttacaacttgcgagaccacattgcttctgcatttgcctgttgtatgagatttacacttgttttaacgcaacatttcgtttcagttgggctggtggccatacctggcactagccagtcaatagtgagatggctcctcatggaggaggcttggcttgaggctgagggtctttaacccacatatacaagagagtt

SEQ ID NO: 462 - DNA, 1322 bp, Homo sapiens
aactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactaagcttgctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagataca

SEQ ID NO: 463 - DNA, 502 bp, Homo sapiens
  modified_base (441)..(441): a, c, g, t, unknown, or other
  modified_base (443)..(443): a, c, g, t, unknown, or other
  modified_base (447)..(447): a, c, g, t, unknown, or other
gccccgtgacgtctcatcgccctctgcctgtccgagcgttcggctcttttgcgtttgctgattggccagcccaggtgacagcgcccacccccaccccccctgacacgcccctggagccttgggggtacgcggtggggggcggggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgacggngngcgngagtcgggggacggagggggtggctgttgtgtccccatcccgcatctctccggcc

SEQ ID NO: 464 - DNA, 5703 bp, Homo sapiens
gcacatccctgcactagtggccgcaaccgagacgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtgatgtgccttcaggacttttttggtgatgatgacatttttattgcatgtggaccggagaagttccgttaccaggatgatttcttgctagatgaaagtgaatgtcgagtggtaaagtccacttcttacaccaaaatagcttcatcatcccgcaggagcaccaccaagagcccaggaccgtccaggcgtagcaagtcccctgcctccaccagctcagttaatggaacccctggtagtcagctctctactccgcgctcaggcaagtcgccaagcccatcacccaccagcccaggaagcctgcggaagcagaggagctctcagcatggcggctcctctacgtcacttgcgtccaccaaagtctgcagctcgatggatgagaacgatggccctggagaagaagtgtcggaggaaggcttccagattccagctacaataacagaacgatataaagtcggaagaacaataggagatggaaattttgctgttgtcaaggaatgtgtagaaagatcgactgctagagagtacgctctgaaaattatcaagaaaagcaaatgtcgaggcaaagagcacatgatccagaatgaagtgtctattttaagaagagtgaagcatcccaatatcgttcttctgattgaggagatggatgtgccaactgaactgtatcttgtcatggaattagtaaaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtgtatgagcaccaagatggcagcaaatcactgaagctgggtgactttggactggccaccattgtagacggccccctgtacacagtctgtggcaccccaacatacgtggctccagaaatcattgcagagactggatacggcctcaaggtggacatctgggcagcaggtgtaatcacttatatcctgctgtgtggtttccctccattccgtggaagtggtgatgaccaggaggtgctttttgatcagattttgatggggcaggtggactttccttctccatactgggataatgtttccgattctgcaaaggagctcattaccatgatgctgttggtcgatgtagatcagcgattttctgctgttcaagtacttgagcatccctgggttaatgatgatggcctcccagaaaatgaacatcagctgtcagtagctggaaagataaagaagcatttcaacacaggccccaagccgaatagcacagcagctggagtttctgtcatagcactggaccacgggtttaccatcaagagatcagggtctttggactactaccagcaaccaggaatgtattggataagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttagacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacatttccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacattgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaac

SEQ ID NO: 465 - DNA, 464 bp, Homo sapiens
ttttttttttttctgttgctgtttaccacaatcaacaagtttttattgataaaaacaaagccatttcaggtgtgacaacagtaacatagttggcaaaaagataaatgggaacatggctctcagataagtcatagcaggcaagggaaggttagaagacagtaggaagaataacatacatatgcataacactttacaaatcatgccacatatatttagcttctttgatcttcacaaaaaccttctgaggtgttattatttcccgttttttagggaaaaaacggctttaaagatttcaggccaggagcagggggtcaggcctctaattccagcactttgggaggccaaggtgggcggatcacccgacgtcaggagttccagaccagactggccaacatggtgaaaccccctctccactaaaaatacaaaaattagctgggcacggtggcaggcagctgtaatcccag

SEQ ID NO: 466 - DNA, 507 bp, Homo sapiens
  modified_base (461)..(461): a, c, g, t, unknown, or other
caggtgtggcaaaatacttattacaaagaaagcaactgcaaccctagagaggggtaagccttctctgggcaatagtcatggacatttacagaggggaaggaagtaaacgttaataaataattctgtaaataaatgctagtacatcataataacataccacttagacactaccatggctttacagcaggttttctctaattcactggaaccatgctattcctgtagagcagctgattctttggtcatagtaccttcaacaaataaactatagaactagagaaactttctaagggaggaaaaagaaaaatcaaagtgatactattagttctgaagttgtgccacttgcggagattttaactttagggattacagagtttcaaggttaggaaatcacaaagctctaggtctcagtgggctaaactttcactcctttctcttcctctacagaagaatattctgtntatcaccctgaacttcaaagggactgtaactggaacaagctcatga

SEQ ID NO: 467 - DNA, 596 bp, Homo sapiens
  modified_base (508)..(508): a, c, g, t, unknown, or other
tgggattcgccagatgccccaagaagggtttatttaattcattccaacaaatgatcctataatgcatttatgcatttaaaagcacagagacacaagtcctcatatatgaagttgttatggttacagaaagaaaataaatatttgtgcacacagagatagcatgaaatcattctacagtgaaaataatagcctctggaaaaagctttgaaaatcagagatggtgccaccaccagacaacacaagtgctggggtacagggcagccctccatgcatttcatagcatttgcatggtttgtgagccccatttaatgacataaaatgagggcactgagggaggaaaagtgaacagacacacaacccgagagcacattggtatttgtttattttgtacaagtgatgtcataagcaaggattttgcctgagtgctagattatctccaataaataaataactatgtacaaatatcttgaggttacaaaatataagacgagaacctttgtgttacganaagtacatttctatgatacatatatttccataaactggagcaggatatcattccttacgttactgaaccaaagaccttcaaaccttgt

SEQ ID NO: 468 - DNA, 2308 bp, Homo sapiens
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagg

SEQ ID NO: 469 - DNA, 2461 bp, Homo sapiens
gttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctacagacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcgtgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacacgagcaagccctctcgggctatatacagaggaagaacagggtgatgagggtactgggggcaagagacatgtttgcagaaccctttaggatggtctaggcttgggagtctcactgcggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagggtctcgctttgtcacctaagctggagtgcagtgcgcgatctcggctcactgcaacttccgcctcctgggatcaagtgattctcctgccttagcctcctgagtatctgggtttacaggtgtgtaccgccacacccgtctctactaaaaatacaaaaaacaaaaaaagattagctgggcgtggtggcaggtgcctgtggtcccagctgctcgggaggctgaggcaggagaatagcatggacctgggaggcggagcttgcagtgagctgaaatggtgccactgcactccagtctgggcaacagagcgagactccctcttaaaaaaaaaaaaaaaaaaaaaaaaaaaaaaaaaaaaaaa

SEQ ID NO: 470 - DNA, 5951 bp, Homo sapiens
gttatccttattttacaggtaagggtcacataaagaaaatgactcccttgcctggtgtggtggctcacacctgtaatcccagcactttgggaggccaaggcgaacagatcacctgaggttgggagttcaagaccggcctgaccaacatggagaaaccctgtctctactaaaaatacaaaattggctgggcgtggtgccgcatgcctgtagtcccagctactcaggaggctgaggcaggagaattgcttgaacccgggaggcgggggttacggtgagccaggattgcaccattgcactccagcctgggtaacaagagcgaaactctgtcaaaaaaaaaggaaagacttcctcaaactaattacattgttgttcttatcaacattaaccagaattgagtacagactgcactatgtgctgttactgtgtcgggctccatgcaaagcacttaacaagatttgttactttatccttataacaactctgtgtggtgtaggtgtaataattatcccattgtccagatgaggaaactgaggtaccaagaggttaaataacttgccatagctcgcagaggtggtaagtggggaatctaggattcacttctaagcttgaacgtggtatggttgtggtatggaaccaaggcaagactccagtctgcttacatctgactcagagatcctacaagaacatgccgactgtccctgtttaaccaaatgtcagtccaggcagcattgtctgtgtccctgattgtgcctttctctagtctgggaacactgccaggcagtgtatgtcactagatgtaaataaggccattatttgattttatgaaactctttttggaggttgagacttgtatattctgtgtgacactcccatttggatatcccaaagacaccttaaattcaatatgtcaaaaaactgaagttatcatttctgcagtctctcctttttgccctgaaaaagaacatgcacttgtttttcatatttccttatctcttggaaagacatcttgaccactcaagaatgtaagctggaaacctcagggtcacctttcttctctgtcactacccctggcttaggtcacccttacagatgtgcctcttaaatatttttcaatcgtgtctctccctattccttcctaccagtgcagccccagactgttgtgtttcatagacagctgccgcagtgccctccagactgccaccatgcctttggctgtgccctcccaccatcctccacactgctgcctggctcatctgtataaggatgattctgtaggcattgtcctgcttaaaaccatgtggtgattccaggcttgagtctgaactcagagcaaggcacatggcattctgcctggcacctgaggccacagcagcatattataggtccgctgtgccttgtgccctgagtatgtcctgttgaggccacttctattcctgctcttccttctacctgggaagcactcccttcccattgcggctgaagcctgtctcttcaaacctcagcccaacttctgcttatcttccagagcctatttgagctttcatcccttctagaagctttccctgatgttggcagagtagttttctcttcttttgtgttaccattacactctagagagacctttgtttctgcatgcatcacagtgtatttgtctttttgaaggcagggactctgacactcatcttgacagcaaaggggtgaattactcaactgtcaattcttttgtaaaatggacaatgtcaaccctgttagaagtaaatgcaataatgggtgtcacgtccttagcaccgtgcctggcccatagtatatacccagtggacacctgtacctcctctccacatccctgttgcatggtgactgggcccagaaggcagctagaattggcaactcaagcccttttggtcaggatcctttgctgggtggaagctcctcgcctactaatgcgggtgccctgtggctgaatctggtgaatccatcaggtccaggttgaaaactactgagcagagccctgctgcctctgggtattctgttcaccacccagcccttttgcatttaatgaatgtaaaaaataatggggcagctgctgttccttactctctcttcctgctgcactaagtctctgtctccctggagaggcatttaaccgcacgaaggtttatggtggaaatgacaaattgcttcttcacaacgagctcaccctgctttctaaccagttggaatcacccttgttcatgtaatattagcaatttacctgtctccttaaccactaaccatcctgagaggatttggcattctttgcagctgttaatcctctcatcacctgagggcttattaaataggtggagtgtacatctagcctttctcctacagtgaacagtcattcatgatcttttcctttttactcagcctctctcctcagctgcctgagcccaggataaggcagggtcctcccctctagaggccacagcggagagagctgggctctggaccggggagtccccggtttgactccttgcttggtcaggacttcctcaacataatcgcctggccctggtgccagggtggttgtggggctgagggaggtgcctgtgcagcccatttccctgtggaggtcagttgcccctttcctttcccttcatcaggctcaggccatccttggggcagccctgctatctgagggggtctctcccgagccgctaagacatagtcctcattcatattgggtgttgttgacaatcatcccatcctctgctgcttcattttgtgacttgtggacccaagtgggtctttgtttatcctgatccaggagagctgggaagggagacagtttgaattgctccgggcatatgttacttgttaatattttaaaatttgacttgttgcagtttttcagaggtattaatctaaaagccatttcatggaaaaaagcaacaaggaactggttttatttcttttaggtgacactaataaccaaacatgagacacatcagaatttaagtggctagtcaaaaaaaaaaaaaaaaataccagtgaaaatagcaagtctacattgatgttagttgttatataacaggcgctgttctaagcgttttgcctgtagcaactcactgaatcctcataattactttatgaagaggagattcagtaacctggtcacataggcaatgaatggccaggattcgggctctaaaactgggtctcctgaccacgacgatccctctctagggctgatggagatcatcactaaatcacctcctttgggattctctgctcgttggaaatggagtgttacctgcagagtactgctgtgacctctcctttaggcctctctgtgcagagactgcagtagtctgtgttagtgctgtcctgttgaagctggtccacacttttctggacttctggttgagccagtctgctcagatacgaacttccaaacgaacctgtttctctttggtcctcagccaggctttgtgacatcagctgctacagctgtggaaacagttgataaacagggtcaggctgctcagagggagaatgtggcagtagggtccctggcaagggttgcctgctcacttggaagggcaaaggcctagaaatccacgcgcaattgatgcacaagctgtcattgtgctgaggcttgtgggcaggggggtgtgtttctctttccttctccccttttcttcctctctttcccttgctctctttctttcttcctccttcccttcctctttccttcctccctttctttctcctttgaaaaactaagatgaggtcctggtaaagatagtacatagaagagaggcttcaagcctcaaaaagttatttcgataatatagtaagtcactgctccttattaaataagaggcctaaggggctgaggtggtgagggattgaagtgaagtctggcttggttcaggcctgaatacccaaaccaggccagctttgggttgggttggctctgcctggcatgaggagacatccaaggattccgtctccctcagagagccatgctgggaaatcttctaagcattggactttgaggttaaaataaagagtcttgcacccttggcggggatttctgaaagattgatgggattctaactgcctaacagttccatttccagatgagcgccctccgtgcatgggctttgtagcagctctctgcctttccttgccaaatgaccctatttgatctggagccctggcttgacttttctcttcagcatctgctgttttctgaccaatcccacaccttcccctggttttctcttttacagaaatcctttcttccaacttgattagatttctttgttggcttgcacatctggtcttcatttagtagggatgacacttaattgaagtaagagtttggctgcctttaaatttaacaactgcaccctgctgggggtgctgatgaggagtcagtagctgaattgtttattgaaagagatcatattgatttgtgattttcacttaagaaatgcattcccacacacccctgcatttagttgcttagctgggcactcagacagctgctttaagaatccagtacccttgtctctggagaggcgtttctcctcagtgtgcatgcagtactactgtatgcacgtggcatgtgtccatctgtcctcacagaggagactgtgcattggtagagctggagggctcctgttgtccacccagcatgccactttgaaccagctcctaaagcatgaggtccatcatgtctctattcaaaaactttcagtggctcctcattgcctgtgaatgaaatatggaatctcagcgggcggtcaggggcctcccagtctggcttcactgtgcctgtccaactcatttcctatgattgccatgcagaaacccagttctctggccacaccgaatttcttacaatcttcccattcacttggccattctgcctttatgtttttcactttctctggaatttcctccctccctttcctgcctgtatggtctcagttcttcaaagcccatttcaaatgaaaacctttgctacgaaatcttccctgattcctctcacctatagtgcacccctttgaactcagacaccctctctgtatttctcttcaggtattttagctcactttatgttataattgtttttatgattgttgtttattcttattcaacagagtcactacctgagagcagtgaccttgtgttggtcacatgtgtcccctgaaggatacagctcagtgcttggggtagtaataattgatattcttgagtgctcactacatgccagttctattctaagcactatacatgtattcatcttggttgatcctcacaaaagcccttggagggaggtactgttattagccccattttacagataaggtaactgagatctaggctgagtaacttgcctaaggctacccaggtagcaagcagcagagctgggggtccacctgggccttctgaatccaggctctcaactagtaagccacatggcttctttcattagctacttgctcaatacatatctatcaagaaaagttgtactgaagttaagagatataggggagcaggaatgggttagtttaaaaacaaggagagggaagaagagaaggaaattagaatgggccagtaggaaaagaaaagaaaggagaagtgctaagaaaccaaggaacaggccaggcgcggtggctcacgcctgtaatcccagcaccttgggaggctgaggcatgtaaatcacttgaggtcagaagttcgagacagcctgaccaacatggagaaaccctgtctcgactaaaaatacaaaaactaaaaatacaaaaattagccggatatggtggtgtgcacctgtagtcccacactcaagaggctgaggcaggagaatcgcttgaaccagggaggcggaggttgcagtgagctgagattgtgccattgcactctaacctgggcaacaaagagtgaaactccatctc

SEQ ID NO: 471 - DNA, 1390 bp, Homo sapiens
gggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttcctttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaaaaaaaaaaaaaaaaa

SEQ ID NO: 472 - DNA, 608 bp, Homo sapiens
  modified_base (233)..(233): a, c, g, t, unknown, or other
  modified_base (237)..(237): a, c, g, t, unknown, or other
  modified_base (289)..(289): a, c, g, t, unknown, or other
  modified_base (348)..(348): a, c, g, t, unknown, or other
  modified_base (381)..(382): a, c, g, t, unknown, or other
  modified_base (462)..(463): a, c, g, t, unknown, or other
gcaagcaaaatattttattgaaaattcagaaaagttacaacactttaagacagcgtttttcatattctgttataaagaaaaatgttaaaagaattgacttgaatgttatatttaggtttcattcaaactaacaaaatcattttgaaaaacaaaaatccacccacagctgaattattcaggggtgtaaacatatattttctattttgttatcaagaaaacgctatgaaatattntttnagtgttcttttcaaaacagcatctttctggacccattaaatagtatttagtnttagattctatcacatagatctgtttgtggggggggtgctgctataactgtgaccaggnctgtaggacagctatttatttgaaatttagatnnagaagatttgcttttacttatatagggcataaaacaatctagctttttgggctgttctatctttaagcacaaacacttcnnaaagtagccctttatggggcccgggttacaaatatcaatgtgccccagttactttctcggaattggtggggggggcactcacttcgaaccaagtttcaatttttaagaggctcgtgcaaaaggcacactcattaaaaagatttgg

SEQ ID NO: 473 - DNA, 1184 bp, Homo sapiens
cttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccattt

SEQ ID NO: 474 - DNA, 3014 bp, Homo sapiens
ctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtgg

SEQ ID NO: 475 - DNA, 1707 bp, Homo sapiens
gtggtaggctgcgaccccttcctcccacagccccttcccgcccctcgccgggcatccgccgacaggacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaaaaaaaaaaaaa

SEQ ID NO: 476 - DNA, 942 bp, Homo sapiens
gaattccgctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaagattggaataattggtggaacaggcctggatgatccagaaattttagaaggaagaactgaaaaatatgtggatactccatttggcaagccatctgatgccttaattttggggaagataaaaaatgttgattgcatcctccttgcaaggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggactatttgccacgacatttcaaaggattccaagagagaatattggtgtccatgctgtgatgattcctcagctcctctcatctgatctccgtcctggcccccatgactttctttgcggtagttagggtgtggtatgtgccactgaggcccacacctattggcaatttatagcactgatctgtcatcaataccacttgctgtcttggatgtgaagatgatttttcctgcagggattccctctacaaaattaaaaacactgggcatgtggaaataatattcacgctttaaattgtcttttctattcactacaccaggggtccccgacccctaggcaacagactgtggccctagtgtagtgaatagaaaagacaatttaaagcatgaatattatttcctcatgcccagtgtttttaattttggtactggtctgtggcttgttagaaaccaggctgcacagcagaaggtgggcagcag

SEQ ID NO: 477 - DNA, 2894 bp, Homo sapiens
gtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggaggtcaacattggcatcctcatcgctgtgaccagagtcatctcacagatcagcgccgacaactacaagatccatggagaccccagtgccttcaagttgacggccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctccgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgcgggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagactcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaaaaaaaa

SEQ ID NO: 478 - DNA, 491 bp, Homo sapiens
aattcagttttcagcaaagctttaaacttttaacagattcctcacaataagaaaaaattttaaagttctactattagaccaacttttactatacagtatttcacataaatcatgttttacatttttttctaattacatacagaaaaattctccaatcaacacaagaatggcagaggaaaaaagatgcattatgcttggcagatgcaaattaaaacacacagacagaaagaagcagtaaaatgtcaaataaatcacacccactctaagtatcaatgaatagctgatatgcattgttgggagaatcatttctgaatgagtttgtgaacaagttgtgcttcttattaattgtgcacttaaaaaatgaccactaaagaataatttaacttgttattaatgttctccagatattaaaaaaaaaaaattataccattaacgtgattaccaagcacctaattttggaaaggcttcataatggatgttttctttttctc

SEQ ID NO: 479 - DNA, 386 bp, Homo sapiens
tttttaaacaaaaaagggaatttattggttcatgtatgtgaaaaatcatgaggtcagtctgctggatgctttggctggatataggcgcacaggatgttgtcaggtctctgcgtgcatctctatttcttgagcatgtgtgcagcttctgttagtctgttacttgttctgtcatacacatgaagacatctttgttttccttggtgttggcttcattttttttttttttttttgcagttttataactttgtttgatatagttgacaatcagtgattagttctcatccacaatgactgtctatagatttttgaaagtggtaacaggtacataggtaaccgaagtacagagcttatttggtgaatcttcatcctcattatattctctggac

SEQ ID NO: 480 - DNA, 934 bp, Homo sapiens
cactgcactggccttgatagggaaaccttccattctactgctggatgagccgagctctggcatggatccgaagtcgaaacggcacctctggaagatcatttcagaagaagtacagaacaaatgttccgtcatcctcacatctcacagcatggaagaatgtgaagctctctgtaccaggttggccattatggtgaatggaaagtttcaatgtattggatctttgcagcacataaagagcaggtttggacgaggatttactgtcaaagttcacttgaagaataacaaagtgaccatggagaccctcacaaagttcatgcagctgcactttccaaaaacatacttaaaagatcagcacctcagcatgctagagtatcatgtaccagtcacagcaggaggagtcgcaaacatttttgatctgctggaaaccaacaagactgctttaaatattacaaatttcttagtgagtcagaccactctggaagaggttttcatcaactttgccaaagaccagaagtcctatgaaactgctgataccagcagccaaggttccactataagtgttgactcacaagatgaccagatggagtcttaacacttccagcaaactcaatctcagcatgtgaccaatggcttcattttgaagaaaagccacagaagatacacttccgcaagatatcttcattttaaagtaaagtaatatactgtatggaaagttacaactgtgttagactaacaagtaattataaaaggaaatttttccttctaaggtcagtgagtgttgttgctactgaaatgaattcctgtatactcaacactgtgagcatgctaatgtatatgctggtgattcttatgcaaaggtgaagccacctcaagatgaatatcttaatttattactttcaataaaaagacagtttaaaaggcaaaaaaaaaaaaa

SEQ ID NO: 481 - DNA, 590 bp, Homo sapiens
gcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttca

SEQ ID NO: 482 - DNA, 2921 bp, Homo sapiens
gcacgaggtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 483 - DNA, 156321 bp, Homo sapiens
  modified_base (41349)..(41349): a, c, g, t, unknown, or other
  modified_base (41523)..(41523): a, c, g, t, unknown, or other
  modified_base (41553)..(41553): a, c, g, t, unknown, or other
aagctttacttgcccacatctcttaattctgtgtcattataggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcctgtatttctgtattcattaaccaacctttggctaccaccctgcctcctcacctctaagaactactattctactctctacttctatgaagttaactttttgagcttccacatatgtgtgagaacatgtggtatgtatctttctgtgcctggcatatatcacttaatataatgccctgtaagtctcattcactttgctgtgagtgatagaattttgttgtttttcatggctaaatagtactctgatgtgtatatttgccccattttctttattcattcatccagtggacacttaggttgattacataccttggcctatttcttggctatcgtgaatggtgctgcaataaacatgggggggtggagataacactttaacatactgatttccttttctttggatatgtaccaagtatcatataatagtatgacatgactcaaaattaaggaataagattgtggaaattggttttcaaaaaaaaattctctagtttgaatatagagaaaaattggtgagtgtcttcagctgtcctcatacataatgcatgtgagctcgctttaagcataagtgaaggagtggaaaaatcctggagatagaaatcaaggggtatacatgtggatgtaaaaaatcaacaaagattcttttaagaaaaggtgtgtatgggtagggaacaatagcatgacagcagtgcggcctctaacagtctggaaccagttaggaaaaagagcaggattgagcgccattccattcatagacaccgtggtgatattttgagtacattaggttaaaaggctttcttcagcaaaatctatctctagagatagatttgatttttataatcaaatctactagagatagatttgatttttataatcaaatctactagagatagatttgatttttataatcaaatctactagagatagatttgatttttataatcaaatctactagagatagatttgatttttatacttaatgttctagactgtatcttttcaggatgctaggtactttatgaagatccatgctgtctcaatttgcatagtgggttggaggccctaagacaatctctccagattctatgatttgctaagaggactcagaatatagttgtactcatgactatattatagtgacaggatacaaataatcagcaaagggaaaaggttcttgtataatatctggagggaatcagatgtaaatttgtaaagatcctttgtgcatggagtaacaggtctcaattcctccagtattgaattgtgactgtacttgtgaaatgtctacaatggaaattaattatcaacccgtaccaaaggttcttattggaactaatcatgtaggtaccatccctctgggacatatcaagattctagactccaagaaggggagcaagtgttcagaataacttgaaccatgcctaccagttatggaatgggggcaaccctctcaaactccgtgtttcctaacaccagctaaaggccagtcttataagcagtcctttctaagatttgcagtctcaggcctgttatattaactttttgtgcacatagtactagaaaactgttggctcagtcttctttttgttttgtgtgttttggtttttaactgtcaccgataccagaatagctcatctccaaggtaactgtaacagaacactcagcagattaaacagaaaatacttgcttattataattattaaaagtttggtagggtctatgtctgctctctggtgtgtcctggatcatcaacttggttacaacatggtgttaacatgtgggactgattgtgtttcttgttaatatttctgtttctcccaaccacgctgaatattaaatacctagttctatatctagtaccctgagcttatgtggggctaatattctttgccatttttcaccacagatttgatttcctttttcttttgtggacactggtgagttccctaatataactttgacttggttatattttcacaatcggtggggattattacagattatcatccttcctctgcatttgaaaaaggagggaggcttcaagtcaggttagttgaccttcctttgttggtcttattatccataacataataaataaattgatgaggatgggcatggtggctcacgcttgtaattccagcatttagggaggctgaggcggcgttttagaccagcctagccaatgtggtgaaacctcatctctactaaaaatacaaaaaatatgccaggtgtggtggtgtgcgcctgcaatcctagctactcaggaggctgaggcaggagaatcgcttgagcctaggaggcggaagtttgcagtgagccagaatcgtgccactgtactcctgcctgggtgatacagtgagtctccatctcaaaaaaataagtttatgagaagtctattaaattgttacataatctatataggtagaaggtttctatttcaagtgaacgaaagtgtaacttgaatcgtctaatgcagactcacagcccaaaaataaattccaagacatgtccactttacaaatccacaattcctttgatggggtgggagggcagttctggataaggatggaccctgctagattgcaaaaaatttacagcactaattttttccccagagatctccataaggacctatggtcatgaacttctgtgactgtgtactcaaaaagagaaataatcacacattttggcagtgactgaattcttgttttcaagtaggataaatccaaaagagactcacactgagacacattataatcaaaaagacaaggaacatcttgaaagcagcagcatgaaagtgacttgtcatgtacaagagatcctcaataatatcatcaatggctctggccaggtacagtggctcatgcctataatcgcagcactttgggaggctgaagcaggtggatcacttgaggtcaggagtttgagaccagcctagccaacacggtgaaaccctgtgtgtactaaaactacaaaaattagccaggcgtggtggtgtacacctatagtgccagctactcaggaggctgagacaggagaatcacttgaacctggaaggcagagattgcagtgagccgagatcatgccactgcactccagcctgggtgacagagggagactgtctcaaaaaagaaaaaaaaaaaaaaaaaagatcatcagtggatttctcagcaaacctccaaggccagatgatgtattaaagtgctggaaaaaaacctggtatattgaggattctatattcagcaaaactatacttccaaaatgagagatcaattaataacttttcagaaaaacaaaagctgagagaattgccagtagacaagttattcaagaattgaaaaggttgggaggctgaggcaggcagatcatttgaggccaggagtttgagaccagcatggccaacatggtgaaaccctgtctttactaaaaatataaaaattagccgggcgtggtcgtgggcgcctgtaatcccagctacacaggaggctgaggcaggagaattgcttgaacctgggaggtggaggttgcactgagccgagattgtgccactgcactccagcctgggcaacacagtgagactccatctcaaaaaaaaaaattgataaagggaatcaatccttcaagttgaaatgaaaggattttagacaataacttgaaatcatatgaaaatataaagatctatactaaaggcaattgcatgaagcaatacaaacaacattatgatagtaattttagtttgtaatcccagtttttattttccatacaacgtaaaagacaaatgcataaaaatgactaccaatctatgtaaataagtacacaatatgtaaagatgtactatgagatcagtaacagtgcgggaaggaaagagctgtgaaggagtagggtttttatatctgattgaagttaagttggtatcaatttaaaagactgttataactttaggatgttacatatacttttggtgactataaagaaaatatcaatgaaacatgcacaaaagaaaataagaagtgattcaaggcaaggcagggtggctcatgcccgtaatcccagcactttgggaggccaaggcgggtagatcatgaggtcaagagattgagaccatcctggccaacatggtgaaatcccatctctgctaaaaatacaaaaaaaattagttggggatggtggcacgtgcctgtagtcccagctactcgggaggttgaggcaggagaattgcttgaacccgggaggtggaggtcttgtagtaagctgagattgtgccactgcactccagtctgggcgacatagtgagacaacatctcaaaaaaaaaaaaaagtgattcaaaattaatcactacaaaaaaagaactcaacacaaaggacaattgtaatgaaggaaatgagaggcaaaaacacaataggacatataaaaaacaaatttaaaatggtagtccttacctatgtataattagtttaagtgaaattaatgaaactccccaataaaaagatgtagtttgtcaaaatgattgaaagacaatatgtaattatatgctctgcacattagaattaatgacatgcataggtgaaaggcaaatgatggaaaaagatatcccatgtaaaaaaaataacagcacaggtagctatactaacagataaattagattttaagtcaaaaactgttaaacgagacattaaatattgctaaaaggttcatttcactaagatgaaacagttataaacatatgtgcaccaaatatcagagttccaaaatataaaatgtaaatactgacagaattgaagggagaaatatacagctctccaataatagtaagagactccctacctttctttcaaatgcataggacacccagacaaaagataaataaggaaacagataatttgaagaacattatacaccaattcaacctgagagacattgacataactctccgccccccaacagaatacacattttctcaactgcacatgaaacattcttcaagacagaccatatattaggccacaaaacaagtcttgataaatgtaaaagtttgacaccataaaaatatattttccaactacagtctagatcataataactagacatcaatagcagtataaaaagtgaaaaaagcctgaggcgagaggatcacttaagtctagaagtttgagaccagcctgagcaacatggtgagactctgtctctaccaaaaaaacaaaaaacaaaaaggctgggccgaggtgggcagatcacttgaggtcaggagttcaagaccagcctggccaacatggtgaaaccccggctctactaaaaatataaaattattcgggcgtggtggtgcatgcctataatcccagctacttgggaggctaaggcaggagaatctcttgaacctgggaggcagaggttgcagtgagccgagatcacgtcattgcactccagcctgggcaacaagagggaaactccgtctcaaaaaaaaaaaagtatatatttgctagttttgtcagctgagagggtcaagaataaaaaacactaaggtagcagcgatcatacctagcactcagttctttgtttctaactacattttccacaaataggaaccagaagtcctaggagaaatatctgatctcatggctagggtagggaaaatacccaatgaacttgaaaaatacctaatgaacttggaacacacagtatcagaaagtaaaccagtgcacaaagagctcatatcatgatgaacaggaggagccagaaggcaagaggggactgcttgaagaggattttactggcaaaatctgagacaaccagagaatcaaaatacataataacagtagtagatgtgaactcattaatataacaagaattcacaaatccacactggtataaacaaataaataatatagatggaaagctttttcttagagcataatgccaaaaaatcaacatagaatgagttggagtatctcagtttttcaccagatagtagtaactttttaggggaaaaataattttagagtgcagaattctggagagaaaccccttaatcaactgttcaagtttagcagcaccagtaatggataaaaactagtatctggtatatcctgagatcatgcactaaggacagaaattgatcataatccagaaagacataatcttgaatgttggaatcgctgaagatcaaaatgttaaaaatataaccctggaaaaaataattttaaattttttagaagatattgactgatttacatttctttcttttcttcctttttttttttgtttttttttctgagacagagtctcgctctgtcactcagctggagtgcatttcccttccttcctccctcccttccactttttttttttttttctgagacagtgtctcgttctgtcacccagattggagtgcagtggcgtgatctcggcctcccaggttcaagtgattcttgtacctcagcctcctgagtagctgggattacaggcatgtatcaccatgccacgcccagctgattttttgtatttttagtggagacagtgtttcactatgttggccaggctggtctcaaactcctggcctcaagtaatccgctggccttggcatcccaaagtactgggtttacaagcgtgagccactgcgcctggccgagatggagcatctcaataaattttgtcatttggaagggccgactagagcaacaatacagctgtaactagtatagaaatagcagtcagtcaattttcaaagagggggatgtgtggcattgtgtggttagcatagtaaccttgtttttatgtaaacacaattgtgaaaaggtatttttttagtttataaaatgaatctagaatgtgagacttcattttttaaaaaacaaaaatatagattgataagtgtattagtccattcccccattgctataaagaaatacgtgagtctgggtaatttataaagaggtttcattggctcacacagagtcctgcagcctgtaaaggaaacatggcagcatcagctcagcttctggggaggcctcaggaaacttacaaccatgctgcaaggcgactagggagccagcacttcacatggccagagtaggaggaaaagagcgaggagtgagatgctacacaattttaaacaagcagatctcatgagaactctatcaggagaacagcactagagggatggtgctaaaccattagaaacctccccggtgatccaatcgcctcccaccaggccccaactccaacactggggattacatttcaacatgagatttgggtggggacacagatctaaaccatatcaataggccaatgtatgtttatggggagaaaaaaatctggttatctttttttttttttttttttccgtgacagagtcttgctctgtcgcccaggctggagtgcagtggcatgatctcggctcactgcaacctctgcctctcaggttcaagcgattctcctacctcagtctcccgagtagctggaattacaggcacgcaccaccatgcccggctaatttttgtattcttagtagatatgggttttcaccatgttctcctggctggtctcgaactcttgacctcatggtccgcccgccttggccttcccaaagtgctgggattacaggcgtgagccaccgcacccagcccctggttatcttgaagaaagattttagatgggtttttttctgattttgctttattctattatttatttgtatcaaccaatgtaagccagattccaaattgctaactataatgacgatattttaaccaaaaaatataaaggaagaaaataaaatatgttccttcacgtataggatcctccttaatgctactgcattaaataaatcataggcattgggtgtctgacatcaatgccaagcgcttcaccagttatacttgctttgaagtattgggcaatttaagagcttctctgaaatttggtgtttttacctcttcagtagacataataccatgaaaagtgtaaacgaaagaagatagcttttccatgaggacagggcttccccactggccctctcaaatgatgattgtttttcctgccaaaccagtggtaccacagcgtctggagtaggggctggcaccttctttgttcttcattgcctctcccaaaccattgtacttgctcactcttccaacttttagttttggcctcatattatcagtttatagtaatcaatcatcaatcatctactgacccctaaaaagtcattccccatttagtccttgaagattgtatctcctcgcttgttctctttccaataatcctccgtagtcctgggaggcgtttagacttcaggaattgctgtctattcaatattttcgctcaaggactcaggcagagggaaggacgactctcagggtcacagtccacattccctaccaagcgctcagcgatataggattcgttccccatgggcagtgcgggaatcgtaggcaaggagcaccgcggagtcccatcgcttttccctgaagggtgagattctgaacgtttttccctcagcattctgagtgtaatccaaacgctcagtggagtcgtggtccatttgacccacgcagggggatccggggaattctgggaaatgtagtcccgccaatcagtggagtcgcgggcacttccgctccagggaagagggggcgattgtcacggcacattccacggtagtttcttccagttccgcgactcgcggcccctcctaatgtcagggacttaagattggggctcgctgggacctggtggtccggttatgggaaaagaagcctcgtgggagagcagaggtttggtggggcgagggcggcggcttttgttgtgtcagcggagccttcttgggctggggctcccctcgtgtcccgcggcgggaggcggggggcattgggacttggttgggtcgcgtctcgcctggtttgagggtttccggggctctgagctcgcccactccgcctccctgcactccaggcgcgcagtcacttttttacagtgcaaggttggcgtgttaatctccctgggcctctccttgctgttctttaaaatggggacgttaggaccatctttgtagaatcgttttggtaactggaataggttacacaacacaaacagtccctgtcacttggtgagtggtggtttcttgttactttcccacgaaacctgttaggtcccccggtggggtcagagctccagcagcaggggcctcagcccttatctctgatccctgcaggacgctggacgatcccggacgccttctgacctctttttaggcaggcgagggttgcgtccacttccacgaagggaggggagcatttaacttttctcagggacagcgacccagtcaggatgtttcacagctttctccttccccagcctgaaaaaggactgcgcggactgacttcttggctactgaaagcaaagctccacgtgagtgtgacttgtcatttttcttttacagagactgtatctttgtagcatgtgtaatagggcatgggcatttataataattaagccttaattgctaacttcaattctaggggatttatacaattagatacgtttaagccgcaacgtgactctgtggagaggtactggtcatccaagtagtaagaggtgaaacttgggttggaacctaggcattcagggtcagagcccgagttgatcatctcttggatatattctcattgaggcagaggaactagctgtactcaggtggggaaagtaagttagaacttgattaaaggaccttaagagcaaggctaattgccttggagttttctcagtttttaaaaactgtcaactattttgtttcatttattacaaatatttcacattctaatagaaccgtatcactgtgaagcattcagaaattacagaaatacgaagatacaaaaattgtaattacctatgaaatcaggatgtaaagatagtaatggttaaatttctaatgcattttgttttagtggttccatgtttatattacttataaatgttttacaaaatttttattatacatttctcaatgtttttctatttatctgcttatccatggaaatttccagataaagagataataaactagtgacctgccatattctatcatgctcattcttattcttctcattattatttctcctatgactatttcctgattttttaaaaaaactttaacacagtaattatataattttaagtctatagaaaagttgcaaaaatagtataagagggcagggcatggtgggtcatgcctgagtcctgagttatggaactgaggcactcagggtcacagcccgagtaatcccagcactttgggaggccaaggcctgtggatcacttgaggccaggagtttgagacccgcctggccagcatgacaaaaactcgtctctggccgggcgcggtggctcacgcctgtaatcccagcactttgggaggccgaggcgggcggatcacgaggtcaggagatcaagaccatcctggctaacatggtgaaaccccgtctctactaaaaatacaaaaaattagccgggcgtgttggcgggcacctgtagtcccagctacttgggaggctgaggcaagagaatggtgttaacccgggaggcggagcttgcagtgagccgagattgcgccattgcaccccagcctgggcaacagcgcaagactctgtctcagaaaaagaaaaaaaaaaaaaaaagaaaacccgtctctactaaagatacaaaaattagccacatgtggtagtgcgcgcctgtaatcccagctactctggtggctgaggcatgagaatcgcttgaacccaggaggagaaggttgcagtgagccaagattgcaccactgctctccagcctgggcaacaagagcaaaactctgtctcaaataaattaaaataaaataaaattaatttttatgagtagatatacttgttagtgggcaacatactgtaaagaccagcatcccctgttcccctgtttgcttattcattcattcaaaagtaaatattctatcaatatggactcagaacgcagtcttgttaaattaaatgacatgtagattaataatttttttccaactttattgaggtgtattttatgtatcagaattcacccatttcaagtgtacaattcagtaatctttaggaactttgctgagtgtagtaatcatcatcatcatttagtttagatcattttcatcccccaattggactcctcttgcccatttacagttaatccccattcttatcctaaatccccatcaacaagtaacctactttctttataaacatttgtctgttctgaacgtttcatatacatgaaatcatacaatctgtggtttggtgtgcctggcttctttcactcagcatagtgtttccaaggttcatgcatgttgtagcatgagtcagtacttcattcctcttaatttccaaataagattccattgtatggatatgccaggatttgtctatccatttttccataggagggcattttggttgtgtgcagtttgggattattatgaataatgccaccgtgaccattcgtgtgctaattcacagtacacatctgtgttggtggggacatccctggccacgctttcatgtctctttttgtgtcttccatagtgttccaggcacgattctgccttctctcaaatggcataactcaggactctgcaaattcccagaaacaggaggaaaaatgaccacattcaaggtgaataaggcttgccactcttgctgttaaaattccatctcactattctcatgtttcctgaggaagactcaagaacaacgggcatttgagaacctgtttatgctaagtgcatccttctgccttttgagttgactttgtttttagatgttgtttattttattatttcagttgaccttctgtatctgtgggtttcacatctaggggttttgcgtctttgaattttgcatttgtggattcaaccaaccacagattgaaacctgagtctatgtaaagctgaccatacatattttccttttgcggttgattgagtctgtggatgtggaacccatggatgtggagggctgactgtagtacaaacactattttagataagggacttgagcatccacaaattatggtatcctcaggggtccttgaaccaattccccaagcgtattgagcgacaactgtatttattttatggagtagaaaaattggtgtgaatgaacagttctcctactttacttctctgcttacgtattagctgtttttattttcttatagtcttttcctaatgtgcattcataactatattggtattcatgatatatatctcatttttgttattttttccttaagtactaaataatgttcattttttgaggttatgccatatacccatttaattaatgtgcctttttatttttgactacttcccattcatggacatttaggtgatttaagaattttattgttttacataacactgcaatgacaattttcctacataaccgtttcctcaaaaatcaattctgaaaactttctgctgatttttttgtcaccacaacctctgccttctgggttcaagcaattctcctgcctcagcctcccgagaagctgggattacaggcatgtgccaccatgcccagctaattttgtatttttagtagagatgggactcctccatgttagtcaggctagtctcgaactcctaacctcagatgatccacctgccttggcctcccaaagtgccgggattacaggcatgagccacagtgactggctgtagatagaatactctaacatggcacagcacaacaggctataatgctgcttcacacaaataatattgttggagttttcatataggaagagctagattctgtgtgctttgtgcctcgatcatactttgtatgtattttatttactagtgtcttattgcctttataaagtaaccagtttgaccaaagtagtaggtaataaccttcatttaaaatgtccagtgacacggaagatttgccagtcacttgtgttctgttactgtatttattcagaacagcagaatgaggaggtttgtggtctcttcttcctcttaaacaggtgaaatatgagaaaccttctcagattggcatagaaagtcaggggtcagaaacattagccattccatttaagtgaaagtgagagacaaaaggaaacaaatatttctcaatgaatgacccgtggtgtgggtgtctggagtgccctgttgggtgataacgtccacaggtagtgggggacctcttgtgttcctaatgtggtggcacctcagatgcactaagatgctcagcactccaggtgcacaaggacagtgattagcacagtggttatataaagtctttaaattactctacggatatccccctcagatagtggtttctcgggtatatacccagtaatgagatggctgggtcaaatggtatttctagttctagatccctgaggaatcgccacactgtcttccacagtggttaaactagtttacagccatcattctactgtcaattctactaataagtggttcattcaacctctgcaccctcattacaacacaagaacatctctgaggagtaccctgaagcatggggatcagggggtgaggtttttggtaagtgttttagtgggtgtgacaaaagataccttacagagtattaagagaaaaacaagttggggcaaaaatatttaccacacaggtgccaaaaaagatgaaattcataataaacattggtattcatttataatcaagtaagtaagaataatagaattgttcttcctaattagattatcaaaaccattggaaaatttataacctgcttttggtcatcatatagagaagcaaggtgcttgcattctctctctctctctttttttttttttttttttttttttttgagacagagtctggctctgttgcccaggctggagtgcagtggtacgatcacggctcactgcaacctatgcctcccgggttcaagtgattcttctgcctcagcctcctgagtagctgggactacaggcacgcaccaccatgcctggctaatttttgtatttttagtagagatggggtttcaccatattggccaggctggtcttgaactcctgacctcatgatccacctgcctcggcctcccaaagtgctgggattacaggcatgagccactgcacccagccaagtgcttgtattctcttgaaagattagggaggcaggaaaaaaggaagaaaatctgccattatgtggtcataatttttaatgtgctttttttctgatgttttattttttatttgcagttatttagtttaatttatttttttgggacggggtctcactctgtaacccagactagagtacagtggtgtgatcatcgctcaccacaaccttgattacctgggctcaagcaattctctcgcctcagcctcctgagtacctgggaccacaggcacacgccaccacatgcagctaattttttgtactttttgtagagacagggtctcaccatgttgcccaggctggtcttgaactcctgggctcaagcaatcctccatccttggcctcccaaagtgctgggattacaggtgtgagcgactgtgcatggcctgcaatcattttaaatacacacgaaggtaagatctgacagtcgggtgactcatgcctgtaatcccagaactttgggaggccaaggcaggcggatcacctgagatcaggagttcgtgaccagcctgaccaacatggtgaaatcccatctttactaaaaatacaaaattagctgagcatggtggcgcatgcctataatcccagctactcgggaggctgaggcaggagaataatttgaacccaggaggcagaggttgcagtgagccaagattgtgccattgcactccagcctgggcaacaagagtgaagctctgtctcaaaaaaaagaaaaaaaaaaggaaagaaagtaagatctacatgaaatgatgttctttgctggattggttataatgaaaacaatattgaaaattaaatattcattaattagaacaggtagatgcagatttcagttccctcgaataatatacagtcatgaaatgaggtgaaatagatgatgatggtaataataatagataatagctaatgtttcttaggtacttagtctgcgccatacactattccaaatgctatatgtagtttctttttcaacgtttgaaagaactctgtcatgtaagaactatcataccaagatgaaactaggtgaacttatccaagatcacacaactttgaagggtacccttgtgtgcactgaggcatgatggctccagatcatgacactaaatgctgcaggtaatgctggtgctgtgtgccctgggtgtacagaaggaaaactacatagcagttttagatatgttaccaaaagcttgttagtttggcagactttaatgaaaagggatagcatccagcgttcctatgtgagagaggaggaaggtgggtgttatcatgtatgttggttctgacttgctaaatgtttctggggcaattggtaatatttaccgaaaggtgaaacccgtgtggctcaggatgcgtcatttagagttctagatggttacttacaaatagactcagtgaagccacaaaggaattgaaggctattgttactgatgtacttttactgacactaaggaaaatcaaagtgtggcattggtaagatggaaggagaagggctgagaaatctacacattaagtctctgaaaatctggaccagctccccctacatactctccactttctcagtgctgtttcttttcaagagtttgttaaaaaggctgaagtaaggtgtgtttgatgttataggagggactgaccttcaaggatgtggctgtggtcttcactgaggaggagctggggctgctggaccctgtccagaggaatctgtaccaagatgtgatgctggagaacttcaggaacctgctgtcagtgggtgaggacatgagctttctaacactcaatgtcagtctcttggagtgattttgtgtcttcaggggttcaacactttggaggtcttgaattagtcgcctacatttgtagacctgactttcctatcagtagtttttagtgaaataaaatgagatagaaatatcagagttcactaaaattaatggaatacatagcaaataaaactggtaaattgcatgagtggtgtgagaacttgtgggaggagatttaatgaaaataaacgggggccaggcacagtggctcacgcctgcaatcccagcaccttgggaggctgaggcaggtggatcacctgaggtcgggagttcgagaccagcctggccaacatgatgaaactctatctctaccaaaaaataaaaaatacaaaaattaaccaggtgtggtggtgcatgcctcttatcccacctacttgggaggctgaggcatgagaatcgcttgaatccaggaggcagaggttgtagtgagcctagatcacgccactgcactccagcctgggtgacagagtgagactgtctcaaaaaaaaaagacattggttagaaatgtaattttagtaatgcaccaagatgtaacagtttttctgttgtttgagataacacctggagttttttgttttatttttaagaagattaatgagtgcagacagaaatgtgaggttagagtgaaggtttaataagcaaaagaagaaagctttttgccagcagagagggggacccaaatggaattccccctatgaggcaggggtttggggtttttatggactgggaaggggaaggaatgtgcttagtttgtgggctattttggagaaagtgtgacttagcttggcccggaaccttggcccaggaccaatcaggttgaagtaaagatatatagagaccggacttacagtttgaaaaaaagaaagtagagtgcccactggaacccactggagcccactgtacctatgcccacaaaaggagaagaaaccttttcctgggagcccgctgactatacagaggacaaaggcattcttatgccaggccttgctcctttatctgagcgagctggaggtatgtacaagcttttatccaaatgggctggaggtttttctatctgtgcagccgtgggcatgtctccaggcacaacaccctgtggtagttcccttattggtgcctgcagcttaaattttttttccaggctgctttttatgttatataaaaataagacactaacccatgggtcaggggctctccaaagacccttcccttgctgtctacctaaggcaagcgaactaactcctttcagaaataggtttttatagcacatatttatgtctatgtgtctggatcttgaaatactgatatttcttcattaggttcttctaaaagtgtttgaaaacactacttttgattgattgatcagtatacagtagtaattcaaattgccagtaagttcagttgtacctttagtgtgtttgttttaaatatgtgactttgcgtgttctagggcatcaccccttcaaacatgatgtattccttttagaaaaggaaaaaaagcttgatataatgaagacagcaactcaaagaaaagggaaatcaggtaagaaccaagcagctaagagtccttgtacgtgattgtccatctgttgtacttctctcccctgctcttgctgccatcgggtccaaattgccaaacctctgtcctggatgattgcaacagccttcgtactgggcgcactgcatccaccctcaatagtataaagtatgttctcctacaggcgttctccatatcatagctaaagtgatcctttggaaatgtaagtcagattgccattcctctacttaagaccttgtacagggctgggcacagtggctcatgcctgtaatccagcactttgggggccaaagcaggaggatcaggagtttgagaccagcctggctaacatggcaaaacctcgtctctactaaaaatacaaaaattagccaggcgtggtggccagcgcctgtagtcccagctactcaggaagcttagacaggagaatcgcttgaacccaagaggcaggttgcagtgagccaagatcgcaccgctacactccagcctgggcaacagagcgacactccatcttaaaaaaaaaaaaaatactctgaatggcttcttatttttcttaaagttgaagtctcttaaaggagcttatagagtcctgcgtggtctgctgttcatcctcctctgcgtctctgactacatctcctgtattctacctcttgctccatcttttccagccacatcatcctccctgctatttcccagacctggtaaggacattgctcgctctgtcgcccaggctggagtatagtggtgcaatctcagctcactgccacctccgcctcccaggttcaagcgattcttctgcctcagcctcccaagtagctgggattacaggtgcctgtaaccacgtccggcggatttttgtattttttatagagacagggtttcaccatgttggccaggctggtctcctgacctcaagtgacccgcctgcctcagcctcccaaagtgctgggattacaggcatgagccactgtgcccgacctggacactgcatttcttactgctgctgtaacatattaccccaaactgagtggattaaatgataaaaatgtattgtctttcagttctttgtttgaagtccaacatgggtctcactacgctgaaatcaagctgtcagcccgtccctgtttcttcccggaggctctagggaaggagaatctgtatcgttcccttatcagtgtgtaggggctgccaaatttcatagcttgtggccctcttcacagccagcaacagtgcttctctgatcattcttctatagttgcatttcccttttattctctcttcatcctttttccactttataaggaccctctaattgcactgggcccacttggataatgtagaattgccttctatttttagttcagctgatttgcaaccttaattccctctgcaaccttaattaccctttgtcataacctgacatattcttaggatgagaattagaacgtggattctttgggggttgattattctgccaactacagatacttctgcctcaaagcccttatttgcccttgtctttgcctggaaaaactcacctacaatcctctcggcccctctcttacttcatcctggtctctgctcagttttaatttcacagtggtggccttttctgacatccttactggaaatgccatcctttactctctgccctaccttctcttgtgtctcatagactttggtttacttgcttgtcccctctctctccccactggaatataatctccaagagtggaggaatttttttgtttgtttgtttattactctatcatcagtgcctaaatagtcctgttacatggcagatatctgttaatataaatatctgttggcataatgaaggcattaatggatggatgtgacctcactctaggggtcttgcagctaggacaggtcatacacaaaccaaaatgaatgaagggggttgcagaacgttatttgttttctgatggctgcacatccagtttcttctgccttaggtgcccttcacgtgaatgtttgtgtgtgcacttgaacctcataccatgaaaacttacaagcatcgtggttgtgaccacactttgagtaacaagccttcccagtggctttcctggaggcttccatcatatggaacacattcatttctgggaaggaataatttttgaatgaagattctgatgtctacttctgagatagctccccccacaagaagataactatttcctaaggtgtcagatagtaactaggttgcaaactgctttcctttcagcacactgcccatctgaacctcatttgcttcttccaaagtgcccatccgtatcactgcccccaggttttgcctcccctgtgccagaggtggaagatttaagatttgagtggcaaaagtgacacagctgaatgttgcctgactctctggttcaaaaatatgctgtgcttttattttctacaaatgtagtagccattaagcatatattaaagaatatagatgtcatacaatttttcctttatttttataaagacctggcttttatgttcaactagttgacattataacctgggaaaaatgaagaaacttcttgctcaaaattgtcacatcatcatagagacttgtcctcctcaaaaaaactacaatttttaagggtcagtttgttaaatctaatcatgtattcatcatatatatatatatatatatatatatgcgccaagagttacatactctcctatgaatattttcccaaggtgtcacggttggaaattgtctttccatttgaagcagtttgtttaattaaggaccaggtaacttctagaaccaaagtttttgagctcttttgagcatgagccatagcaagaaacgcatttttcattgaaattagaacaatgaaacaaacatttcatgtctgtatagattgatattatagctttagtaagcatttcagaaggacccctttcctgctggtggtagtactctgatagtttctatcctggttcttttattctgaatgcttattacaagcttttaaatttatttcacagctcactaaagggctacagtttttaatttgaaaaactgttgtgaaaggcccaacttacctacactgagagcttcagaaggaaccagtgtatagggcttcctgctttctttttatcccaagtgattcttgccaccttcaaattttcttattagcctcaccctggatatacctgtctcttgtacaacttttcagcttctctgcaaaattacaattttctgttcttttcctatttcaaataacatttggaaaagatgcttttctcctaggacttggcttaaattctcacacaaaaaaagtcaagttggggttcatttattcatttgacatgcatttattgagcattcactgtgacaggcacagttctggacaatggttataaagtaggaaagtgtaaaacgagtattatgtcaaaattagaaaatgcttccctcattgatgctgcattgtggtgggaaggacatacattaaacaaccagtaatttagtgtgtccagtggttaaaagtgctgtgaagaacatagacaaattcaagttgctagaggtgaattgggtgaagacaggattcattatttttcaatgagtaataaagcagccctcattggtgagctgacattgagcagagacccacaagacgtgaggaaccatccatctcgctatctgggaagagttcctccctgaatataactcctgctgtgggggtggctttcaaagtttacactgtgacatctttttcttctccctgtctccatctcaattgtgaaagattggagtctacttctttttcacttttttttttttctggaggtctaaattactgtcagcttttagaataatacatgttatcagttcaactttctttccctttagtcctcatgtaggaaacttgctgacagaagctaaagtttcaccatctgcttatctgctaatattttagtcagtatgtggttaggtacttgctcccagcctgcaagtcatgttaaccattccagtcacctggatattgaagtaactttccaataaaatgactcagggcagagttatatagacaccatttaacaaatgtctactgatacaaaggaggaggtagatttttttctctttttcttttttttttttttttttttttgagacaaagtctcactgtgtccctcaggctgaagtgcagtgataaaatcatggttcaccgcagcttctaactcctgagttcaagcgatcctccatctcagcctcccaaatagtgttaactacgggtgcgtgccaccacatctggccaatttttttaaaagtttttttgtagggccagagtcttgctatgttgcccaggctggtcttgaactcctgggctcaagtgatcctccggcttcagcctcccaacatgcttggattacagatgtgagccactgcaccctgccaagaggcagcttttaaatgactattcctgcaggaggggagtaagtttttcctctgtaaaaatttccttagaggtacgtctttctgctaaacttttgtggaagagttcatttaaaaaataatttccaaatatttatatctctttatacaagattaaacattttggaatattattaaggataaacctttcagaagggtttaaacattttaaatctaagttatattagaagtggtcaagagtttataatagttgtcagctcatttaatgtctgtcaacacagaaaaataagattaagtgtatatgttatgcagaatattcaagaatatggttgatccttgaacaacttgggggttagggacaccaactcccctcacagtaaaaaatccaagtataacttttgactcccctctaaaactttactcatggcctactttgactgaaagacctactgataacatagtcaattaacacatattttgtatgttataatgtattgtatactatattcttacaataaaggaagaattctttattcttacaataaagagaagagaaaatgttattaagaaaattataaggaggaagaggaggggttggtcttgctgtctcagggatggcagagatggaagaaaatccatgtataagtgaacacatgcaggtcaaacctgtgttgttcaacggtcaactgtattttgaacatgtaaatataaacatttcaggttatttaataatttgaatatgtaacatgaacctaaactgcaaaatatttgattattttcttactttcccttgaagttcttgttgatttatattatctacatttttttttaacttttaatatttttaatagaggtacattcttgctttgttgcccagactggtctcaaacccctggcctcaaactatccttctgccccagcctcccagaatgctgggatatacaggcatgaccatgcctggcctatgctttttatatttagataatttactatttattattctacactgactttaaaattcgatggaaatggcagtacaatttgtatcatgttaatttttaaaattaactctgacttctaacttgtgtctcacataggagacttggtatggtctaatgcctggtagatagcagccaattggaccacctcttgatttatctaggcatggaaatcagagatcatgatacacagtggaaaagaccattacacaaactggaccttctctggatttgttaaaatcgcatgctctcgcctaagtatgacatcttgaaaacttttaacagagcctccacatctctgaattctctgtccttacagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttagtcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggagtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttctacaaggtgattaaaaaaaaaaaaacagaactcatgtacaacctgaatgcttgtaattagatttcataggagggaaaaattttctttatcaacctctttgaatttatttgatttgtaacgctccacatttccacctagacttttttttgttttttattttttgttttgaaacagaatctcgctctgttgcccatgctggatgcagtggtgctatctcagctcactgtaacctccacttcccgggttcaagtgattctcctgcctcagtggattacaggtgcacaccaccacgcctggctaatttttgtatttttagtagagatggagtttcaccatactggccaggctggtctcaaactcctgacctcatgtgatccacccacctcggcctcccaaagtgctgggattacaggcatgagccaccgcccctggcctccatctagactttgaaatgattgccttctaattacagtagcattctcttatttaaaatatttgttttatttaagtcagtgtttaagcaatagctcagcatatcccagtggtccagtgaccacacagctgagaacccttgttaagtggtacagtaaagcattctgtcaaaactttgacatttatgacatgttacctaggaaataggacttagaaaatgagtttgacctgggctttaaaaaagtatactgatgaaggtgccagaattgatgtccattagactgtaagctccatgggggcaggaactttgctaccgaatctatacaaccttaacattgactagtgcttgtaggtgtgctcaatacttgtttgttaactgaatcaaaaggagtaaatgcacaatatttgaacattgtatccaaaggaagaaacctgcgaaataaaattatttgcagaaatgaacatttgttgaaatgcagaaaaccactggatactgcagcctacaatattaatatgatattactcttttacagttgacacctgtcctctctgtagtctcttctctcaaatttggttcttattgagagcctgtctagtttcccaaaggttttataaaacataagttgaagtacctttatttttaattttatttttgagacaggacctcgctctgtcaccgaggctggagtgcagtggcataatcatggctcactgcagcctcgtcctcccaggctccatccatctgcccatctctccctctgagtagctgggaccacgggcacgtgccaccacacccagctaatttttgtatgtttggtagagaaagggtttcaccacattgcccaggctggtcttgaacacctgagctcaagcaatccaacctccttggcctcccagtgttaaattacaggcgtaagccaccacacccggccaagttgaagtatattttgtgatttttctgacagtgcagactgaaaaaaatttaattaacctgacaagagtttactgaatatcacacaattgagtttttaatccattaatgttaaggcaggggtttactctaacacttttaaagtgtcagaagtagttgccaatgccaaatttttatcagcccccttgaatttatttgatttctgactttccacatttccatccagactttgacatgattgccgtctaataactgtagcattctcttattaaaacttctggctgggtgtggtggctcatgcctgtaaccccagcactttaggaggccaaggcaggtgaatcacctgaggtcaggacttagagaccagcctgaccaacatggtgaaaccccatctctactaaatacaaaaattagctgggcatggtggcaggcgcctgtaatcccagctactcaggaggctgaggcaggaggattgcttgaacccgggaggcggaagttgcagtgagccgagactgcgccattgcactccagcttgggtgacagagcaagactccgtctcaaaaaaaaaaaaaaaaacttctgaggtaggggctgtaccatatttttgccccacacccattaagcgaataccaaaaacaacttgtggaaatttgataattttatcaaatttattatttgggcaggattggcatttaccatgcttttccctattgctggcagtaaaacatgggtttaaggaagagtgtttttcagaatttacactgtatatctctgatttggaagttatataattggaatttatgattatgagattaaaataccaaaaagactaagtaacatatcagtgatgtcaatgaattgttttaaatggaagtgtgtgttcctctataataatttgacttttgatattttcattcctgtattgacctgaagctattaaaatggcggcaggtatctgtaatgacaggataaagaaaaaatatgggctttggaagatcatagactattgcctttgtagcataatgaaatctatacatttttatgagtgagtgtgtatgtacatgcataagataatatgtaaaggatacttttttttttttagcaattttctcttgcaatgagcattttgtggtatttttccattttataattccataaattacattttaatttcttattgaacatcagtattaccaaagcagtaaattatgtacattagaattttaaaaagtgctatatgataatcccttcaaaatatgattgttctatattgttatatggcacataagatcataattaatagattctggaagccaattttaaaaacaaaaaaattctctgaatatgtggataaatggatgagtgtgaacaattgtatctttgcaattaatgtctgctacacttcttttttttttttgagatggagtctttctctgttgcccaggctggagtgcagtggtgcaatcttgaatcactgcaacctccgcctcgcgaattcaaatgattatcctgcctcagcctcctgagtagctgggattacaggggcgtgccactatgtccaactcagttttttttttttttttttccccgagacggaatctcactctgttgccaggctggagtgcagtggcgcaatctcagctcactgcaacctctgcctcccaagttcaagcaattctcctgcctcagcctgctgagtagctgggactacaggtgtgcaccaccacgcccagctaatttttgtattttcagtagagacggggtttcaccatgttggccaggatggtctcgatctcttgaccttgtgatccgccctcggcctcccaaagtgctgggattacaggtgtgaaccaccgtgcctggcctaaattttgtatttttagtacagacgaggtttcaccatgttggccaggctggtctcgagctcctgacctcaagtgatctgcccgcctcggcctctcaaagtgctgggattacaggcatgatccactgtgcccggccttgcttgctacattttttaaagcattaatctgtaacacagagagaatcctggaaatgaaaacaaagtggtatacatatgttagggaggtatgtttaaaaaggttcactgaggaaaaagtgtgcataagagcagaatatagtgcaatccacttactggatgtggaaccagtaaggacaaagagtgggtttgaatgacattccatattccttggacatgatggtgatattttcagtgtagttgattaaagcatgggtccctaacccctaggccacagaccctgttaggaacagggccagacagcaagaggtgagcagtgggcaagtgagcaaagctgagttctgccttctgtcagatcagtggcatgaaccctattgtgaactacgcatgtgaaggatctaggttgcagccaggcgcagtggctcatgcctttaatctcagcactttgggaggctgaggtgggcggatcacctgaggtcacgagttggaaaccagcctggccaatatagtgaaaccccatctgtactaaaaatacaaaaattagccaggcatggtggcaggtgcctgtaatcccagctacttgggagactgaggcaggagaatcacttgaacgcaggagatagaagttgcagtgagccgaggttgcgccattgcactccagcctgggcaacaagagcgaaactctttttttttttttaaagaaaggatctaagttgctcgctccttgtgaaaataaaatgataaatgtaatgtgcttgaatcatccccaaaccatccccatccccccacctcaccttgtggaaaaatattgtcttctgcaaagctggtcccctgtgccaaaaaggttgtgaactgctggattaaagggctttactcaataaattatatctaactggggagacttttttccactattgattttcttcagtataccttcactggatgcttgctactcattaaggtccatgctacctcaatgtgcatggtatgctggggattgataataccaccttcacattcttgtaattcactaggaggactcaagacaccctatgttatcatagtcactatgatttattgtagtaaaagataccaagtcagttgagcaaagggaaaatgtgcatgggatgaagtccagaagaaatcaggtacaggcttccaataatccactccctgtagaatcattcatgatgtactgttttttcagcattgaaacatgtgaaatgtctacccagtaagctcaatggagacttagtgccctaggcactacgttgtgttttgttttggaactggtcacataggccagcttgggccaaaattctagattcccagaaggaattcagcataaatcacattatacaaatagccggggcatggtgagccactctcatcagagaattgtggaaatcctcctgaaattcaagttcccagataccagtcaagggctaaccttatatcttgcgctgctataacagaataccacagattaggtaatttataaacaatataaatttatctgtcatagtgcttgaggctgggaagtccaaggtcaagatgctggcaggtttaacatctggtgagggctgctgctgtctgcttccaatatggcatccagttgctgcatcctctggaggagacagatgctatgtcctcatatggtggaagtgatgaaaaagcaagaagggattaagttttaacaagggaacaccatcaaactatagcatgttgcaagcaggccttttaagtacaacagtctcaggcctatgttaactcttttctgaacaaagggcttcagaaatccagtacctatattcttttctttctttttctttctttgtatcaccagataccacattaggtcatcttccttcaaggtaatttgtaaccaaaaccagtagactaaaccaaataatttcttgcccctctgccccataactgataagactgtaggtacagtctacatctaccctcctcatgaccagagttttcaggttagtcacaagacagctgtagaagctgggagctatctggctttgtttttggttggttgttgtttgttcacagtcaagaggagagaactgtttcatttgtaatattgtatagttcatgtctcccaaaatgcatggctactctaactcccattcacacacaagattaattccttagctcttacctagtatgcccagcccttgtgggatcattcagttttttcatctgtgggcctaacttgcctgttcatctttggccgttgggatttccctgtcttagctttgagtttagctacattttaacgctttaggggatattgtcacataacatttttctatctttgaaaagatccacaatattatgtaatgattaccactatctaatcctagaactctttcatctgctcccaaaagaaatcccctacatgagctgggtgtggtggtgcatgcctgtagtctcaactacccagggggctgaggcgggaggatcacttgagcccaagaatttaaggctgcagtgtgctatgatcatgcctgtgaatagccactgtactccattctgggaaacataacaagacgctgtctctaaaaaagtaagaaaaaaaaaaccctacatattgacagtcactccccattcccaactacatctccccagccttggagacaactaatttactttctgtctctatggacttgcctattctgcacatttgatataaatggaatcataccatatatggtatcttgtgtctggcttctttcattggacataatgtcttcagagttcatctatgttataacatgaatcaatattttgttcattcacattactaaataatattgcattatatggctagaccacattttgtttatccactcatcagctgatggacattgggtcttctccactttttgactattatgactaatgctgctatgaacttttttagaacaagtttttgtgtggatatctttcagttctcctgggtatttacttaggagtgaaattgctggcacataagccccagatcgggtgccagcagattcagtgtctggtgaggtcccgctttctaagtcatacatggtccttctggctgtgtcctcacataactaaagaggcaaaggagctccctcaggccacttataagagagcattaatcctattcatgagggcattgccctcttgatctgatcacgtcccataggttccacctcctaatatcttcttgggagttaggatttaaacatacgaatttggtgggggccataaacactcagaccataataatacctaaagagaagtgagggattctgggaaatgaaaaccaggagctcaaggtagttggacacttccacatcagaaggcttggacattccggaagtgtagtccaggagggcggtactgttctgtttttcccccaactccagcattctgtgatatgtagtccggagttccgtgtagtcgcgcatagctcagctgcagtaaggctgtaaatgtttcccctgcggaatcctgggaactgtaggtccaatcgttctaggtagttgtaggcacttccggctcgaggaaggcagtgctgtggaattctgggaagcgtagtccaggtcctcctgatactcgcaggcacttccgcccaggaagacgacgtagcagccatcttttccctggctttggtgattcaggtcagcttctcaggaacctttcaaacttccccgaaatgcacttgtggtcagcagctagcggtcttttgtttggggaaaaaaaggagtagcggctaagagcggaggtttgaggggccaggatgctgttttgcgtttccctgggcggagcttgttagaattgggggcgtactggcttcgggcggctggggtgatgcttcgtcgggtttgaaggtctctcgggctgttcgctccctcattgtgactcccccacctaatgagccagccctaccacttcatacagtatcacattgagcgagttagttaatccccgtgccttcgtttgctgttctgaaggaaaataaaagcaaaaacttcctaatagaatgttttgagagaaaacgaggtaatacaaaaagtgtaaaactgcctggcacgtgaattaccaatactactgtaattttcctagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccatgtgagtaagacttgttgttattcttgttttattcacataaatcagagaatgtgtggggtcatgtatttgggcatgagaagtgattataatttagcgttagttgctaagttccattctaaggggtttatacaaatgaacacctttccactatacagtggctctgtgaagtgatactctttttccgaggagactgagacataagaacataacttgtttgctcatagccacctagctagtaggaggcagagctagcattgaaaccgaggcagtctgagtctagacctgagtcttctttggtatgttctgcatgagccataggcagctggctagtatcatgtgaaaataggttgggacttcactgtggggactttgctcaaggtctgggctattctatgacttttaaaaaatagtggctgggcacagtggctgacgcctgtaatcccagcactttgggagtctgaggcgggcagatcacttgaggccaggagtttgagaccagtctggccaacatggcgaaaccccatctctactaaaaatacaaaaattagccaggcgtggtggccaacacctgtaatcccaggagtttgggaagctggggcaggagaatcgcttgaacccaggaggcgaggctgcagtaagctgagatcacaccggtgcactccagcctcggcaactgagcaagactctgtctcaaaaaaagaaaagagtttttaaaaatagttttctcaattattagttttatttgtttcaaataatatagaggtaacacataatcatggaaaacacagaaatacatttaaaaaatgtaaattccccatgaccttagggtataaagataacaactatagtttagtgcctttctgtcaagtttttcttgtatatatttctgtttattaggggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaagatcccaaggtgagcgagatgcatgttaaagtttgagaagctcaggaaaaggtcttatctggaaactcaggactagaaaactgaccctgccagatgtcacagataaaactgagctggccatactagaaccctactcagtccagtgatttttctttcccactaaatattaactgtcaagtttctttgcaaaaaccatgacatgagtagaaggcagctgtcaagtctagagtcaaaatggagaaactcagagtcctgaagatctatttctcccaggctttggggagtagattccttcccatcttttgtactggaggccttctgcctgaagtgggaagatcagctacctatttattgttaattaacgttagatattattgccatagttgtcatcatctcgtcatcgttattattctgattaatgactttcctaatttctttaactttttttttttttttttttttgaggcagagtttcacttttgttgcccaggctggagtgcaatggcgtgatctcggctcactgcaacctccgcctcccaggttcaaaagattctcctgcctcaacctcccaaacatctgagattacaggcacccgccaccacaccggctaatttttttgtatttttagtagcgatggggttccaccatgtttgccaggctggtctcgaactcctgacctcaggtgatccacccacctcggcctcccaaagtgttgggattatgggcatgagccaccgtgcccagccaactttttttaaaaatataatttcaaacttgtagaaaagctgcaaaaatgataacgtaaggaaatctcatatactctacacccagattcaccagttgttacgtttgtttgttatgttatgttttccctgtgtgctctgttgatgaccatcagccatcaccaggaacatacctgtaaccaacaacaattgtttgttttagcttgctgcatccaaggagcccacacatgcatggggtgtcttggtaagaggcaattaggaggaccctggttatagggttttggtttatgttagatgagttggggagagttttaggcaatgggtttgttctggattggatgctgtgaagaagcagtagtaatttgatcagactattgtaatttttatgttggaggtggggaaataacaagactggagttgtcactgataacaaagtggtcatgttagatggaagaggcaattatttggctatttttatcaatgtaggatgtatttctctctgtgttacaagctgttttgtttttttctttttcaccatgatcactgagtagacctgtctcattcttgttgataaattggaaacaccaggttctggttgttgctgctgttgtcaaagtagttttttgttttgtttttttttttgtctttttgctttcacaactttgtcatacttatattttgtttttgtctttttgctgaagtatttgagagcaagctagagatagtgatgaaaatgaaattagttacattgataacttactgttatctaacccacagtttgtatttaaacttactccattttcccattaaagactttgaaagtaatttcttcccccagatgagtttccagtctaattgtatgcattgcacttagttttggtttcattagtcacctttagtctagaatgattcctcagactttatttcttttttgctctcgatatctttctagagtattgagaaattatttgtaaaatgttcttatttttttgtttccttaatatttattcatgattaaattcaagctatgcattgtcagcagagatgccataaaagtagggaggcatccttctcagtgcatcataggagtcaaatgttggtttgtgggtttgtcccactagtggtctcaactttgtttttttggataaaatgtctgccaggttacctttttccttttgcacttaatactttgagactatgtagccatcttattcctcaccaaactcaccagtttttagcagctattgatgatgttctagttatctttcattctacctttattagtttatgtgttctactataggagctttcttttgtcacccatttatttattacacattcttttgtttataacaatatagactcaggttcctcccttttccttttttttttttttttttttttttttttgagacagagtctcactcagtcgccgaggctggagtgcagtggggcaatctcagctgactgcaacctccgcctcctgggttcaaacaattcttgtgcctcagcttcccaagtagctgggattacaggtgcctgccaccatgtccagctaatttttgtcttttagtaaagacagggtttcatcttgttggccaggcttgtcttcaactcctgactgtaagtgatctgcttgtcttggtttcccaaagtgctagtaggattacaggcatgagccactgtgcctggccaggttcctgcatttttaatttaagttaggtatggattgtcaaacggtgttttttaattgcggtatcttcggttttattagttcagtgttggcaaattattggaaagacgacaagatgtttttcagaagttataagacactttcacgtgacatagcaacaacctgtgaactccaactatcttataatattctgttggtggaaattatatttttaaggataatttcaaaccatagaccatcttctacttattgcagttgcaaataaataagatacctgactgtgttgtaagagctttctaccttccagcaatccgatgaggttggtactgttattctttaccacttgcagatgacagaagtaaggcaaagagatgttaatagtttccccaaggtgacgcttttagtgtcaggattttaacccatgcatatcaattccaggcctactgtacttatattgtctcaatttacgctgtactcaaaataagaattactggcgtgcaattacaggcacatgggcagtgaggccactgtgtggttagcctggttctgaactactgctgaaaggggtagttggatatctgggatccatgtcataatctgcttaaaagccacataaagctgcagccaccccaagaagcacacacctttgctaattcctaaagagcagccacgtgcattagcaacatacttacccagttttgatttatttctctcttctttcctagttcagcttcttaggactctgcacttccccagaaggaagaattaaaaatgaatatgttcaaggtgagtagagcttgcctttcccagctgttaaaaataccattttagtactcagagatggaaccaggtttttctttttcaagtaagagtcaaggcatctgatgacctgttgagtgtgctaggtgcttattttgttccgtttgagtttagctggttttggttttagttttatttcgtcatttttattttacaaataaaggtagaaaaattaatagaaatgatgggtgggcacagtggctcacacctgtaatcccagcactttgggaggccgaggcagggggtgggatcacttgaggtcaggagtttgagaccagcctggccaacatggtgaaaccccatctttactaaaaatacaaaaattaggccgggcatggtggctcacgcctgtaatcccagcactttgggaggctgaggcgggtggatcacaaggtcaggagatcgagaccatcctggctaacatggaaaccccatctctactaaaaatacaaaaaatgagccaggcgtggttgcaggcacctgtagtcccagctattcgggaggctgaggcaggagaatggcctgaacctgggaggcggagcttgcagtgagcagagatcgtaccactgcactccagccagggtgacagagcgagactccgtctcaaaaaaataaataaataaaaaataaaaaaattagccaggtatggcggtgcacacttgtaatcccagctactcagttggctgaggcaagagaatcacttaaatttggaaggcagaggttgcagtgagccaagatcgtgccactactccagcctgggcaatagagcaagactctgtctcaaaaaaaaaaaaaaaaattaatagaaatgaaaaaatcttatttccataatctcttcattgtatgtacttgtaattatatattggcattcataacatagatataattttacatttcttacatttataacatttatttttgttgtatttctatcaaatttatgtatccagtttttaaactattctctatatacagttagtgtaggatttttactgttttaggaactacagtgttagttttcttgcatttaactttttctgaaaaaatcaattttgaaaaatactgccttttaaaatccgtaacattaggtattcagaattgaaaaggtatgttttgtgtgtggtacttcagattttttttgatagaatattcaaatatggcacagtgtgtcaagatttaacagctgcttcacccagaaaaaatattagacttttttttactacaagagctagattctgtcttccccatgcctcagtcataccctgtgtgtttactggtctttttcccttttaatattttttttagttaaagtagtatgtgaccttaatttaaaatgcctagtggtaggaaaggatttgccaagcacttacactctgcccctgtattgagacctcacagcaactatgaagaggttctttgttttgtctccattttaaacataaatagaaaagggcttgtgaaaaatgaggaacgtgctcaagttcacatggaaaactaaagatccgggatcagtgtattatattcaagtgaaagaccaagacaggaggacagagagagtccttcattcagaaacctgacatgccctttaggtttgtttccacatataacgctgctcacttggctcccacctcagtaggaaggcaggtgctatcaaacactattgggactcaattggtaaacctttctggggaaattggcaatgttttaggttcagcaggtaacagttccaggaaattcccttataagagtactcactgagagcatccagtaaatatacaaagctttctttttcacagcagcacttttggtaagtcagtgtatggcattggcaagacaggagaagggctgggaaatctacaaacggctgggcatccagaacaactttccacctgttctcagtgttacccatcttctagtggacattggttgtaagattgaggtcatttgtttttgtcgtaggaagcggtgaccttcaaggacgtggctgtggccttcacggaggaggaattggggctgctgggccctgcccngaggaagctgtaccgagatgtgatggtggagaactttaggaacctgctgtcagtgggtgaggacagcctccctctggaatatctttgtgcccttggagttttaaggctttgtggcccttgaaattgttccctgagtgtgggaatctgactttcctaatttttgtgggatgcagngacactggatgtttctggtctttctgaacngaatattttaggtctttttcatttgtgttttatagaagaactgtaaatgaacagaatactgctatgccttgtctattctttttcatgttttacacctgtcccagtattgaattataaaaccaacttattgaatgtcatcagcagattttaatgaaataaaatagggtagaaaatactagaactccttaggaagaatggcacacactgcagcaaaaactctggccaattgcttgagtgatgtgagaaccaatgggagatttaaggaaaacagacattagttaaaaataggttattcaaacttggttttcataatatgtatttacgcatgtgtgtctgggtcatgaaataaatggtgtttctttactgaagtcacaatttaaataaaagtttgaaaaacactgctttcagtgtcttgaatgtgcagttgcaactcagatttccagtgtattttaactctaatatgttcattttcaacttgtgatttggcattttcacagggcatccacccttcaaacaagatgtatcacctatagaaagaaatgagcagctttggataatgacgacagcaacccgaagacagggaaatttaggtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgacagagtcttacacggtgtgcttttcatcccccactacctctctaaatatatcttctatactctctttctgtgaattccagccacattgtcctccctcttgcttttcagacctatcaaggatgcttctgcctcacaaccctgtgtgttcttccctctgcctgaaataatcttttacctataatccttctggtcccttcttcattcatttctttgctcagttttagtattataagaaaggcctcggccgggcacggtggcttgcgcctgtaatcccagcacttcgcgaggctgaggtgggcagatcaatcatgaggtcaggagatcgagaccaacctggctaacacggtgaaaccctgtctctactaaaaatacaaaaaatcagctgggcgtggtggtgggtgcctgtagtcccagctactcggcaggctgaggcagaatggtgtgaacccaggaggcagaggttgcagtgagctgagatcgtgccactgcactccagcctgggcgatagagcgagactgtctcaagaaaaaaaaaaagaaaggcctcctctgaccaccctattaaaaatacattctctccatttactctctgtgcactgccttatattgtgtgtaagcactgattatcacctcatatatgtttttgtttagtgacgtttgtctcctcactggagtgtaatctccaggagtggaggaatgttatctatttgcttctgtctcctcagtgcttagaatagtcctagtatatggcagagacactataaatattagttgaataaatgagttaatggaaatctgtcttccatggaggtaactaataggtggtgaacaaatcagcataaataagggatattgcaaaatattttttgtcttctaatgaattcctaacctaattctaatttctctttgtgtgtgtgtgtgtgtgtgtgtgtgtttgcatgtgtttgcctgtctgtacaagttgacccatatcttggggaacctatagtgtcatagttgtaaccaaactgaataacatgctttgtttatgactttctttgagcatttgtagcagagcatattcattcggggagggaatattttacaataaggacttttatttctatttcttaggtattcccccatagaagggaataaaattcgatttccttatccattatatcaggaaagaaaaagtaaaactaaaaaccaggacatgagcattagcctttccctcaaaatgtttgcacagttgcatcccatttgcttcttccaaagtccacattcataaaaagaaatggatcttacattgttgcctctcaaacatttatatcgtgtaggcttatatgtatgtctttagaaggccttttatgtaatgacaccattactgcttgtgattattctgatatgatactttatctgtttttttttcctaaatatcacaagctattaaatttatttcacaattgactagtagaccactttgtcaatttggaaaacattcttgttaaagacaaacatatctacatccagaaactttctataccttgctttcaaagagacagcattctttgctagccttccaattttgactcagtgcaaaagccttagaaggatccagtgcataggtcttcatgctttcctttcaccccaagtgattatcaactttgatttttctcttcagcaataactcacttggtgtacccctacctcaggtacagcttttcaactttgcagcaaaactgtactttctagttctttttgtatttcagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttaaggcaggggtttaagtgtcagagttgctaatgacacattttttagtagatgttgatcattggttttttcacattttcattcaggctttgacatgattgccttctaagggctttagcattactttaatcagagtttaggttgcggctattgcagatttcttttgtgaacttctctcccccatattctgagaaaaaggacaaaatattagttaaaatttgataaatttcatcaaaaatcgatttttggagcatgactttcaccctttttcctagtggtggcagtgaaaaaaatgcttttggaagagaagttagtatgtatcagaatatagaatgtgcatctcttttttctggaattcatagaataggaatttttgattaggagattcaagtagaaaatgtaagtagcacatcagtgttaatgaattttgtaaaaatagaaataattttttatatactacagtaaaaaggatccttgaaaatgatgaccaaattttatgacagaagagtgtaacagtttagtttaagaacatcacaggctgggtgtgatggcccacgtccataatccccgtactttgggaggccgaggtgggtggatcacctaaggtcaggagttcgagaccaacctggccaacatggtgaaaccctgtctctactaaaaatacaaaaggtagctgggcgtggtggtgcgtgcctgtaatcccagttacttggggtgttgaggcaggagaatcgcttgaacctgggaggcggaagttgcagtgagtcaagatgttgccactgcactctagcctgggcgatagagtgagactcagtcttaaaaaaaaatcacataccttaaattcgtgtgtgtccatgtgagtgaatagtgcatctaatcgtgagtctgtcctatgccaccacagcatcgaagagaatgcaggaatttttttcacatttaacttctatattttaattttttaactgagcatcggttttatagtaaaatactgttattttacagtaacatagtaaaaatataatttaaaaaattactagaatatattaatcccttacagttaagaaatcttgtgtcatcatatagcatataaggccaaaattaaagaatggaactctggaaatcaattataaaaacttgtatggtggttcaaagatacagatgcattggtaagagtgaatatatatttgcagtgaatgcatttgaagctgcttcttaggtacaaatctatgcaatcaatacagttttaatgtaattccagtagtaggaatgcttcttaattcttgacagacttactcactggctgaatggatagataacccagggcactggcttgtcttttcaagtgcttggtctgattgggggaaatggctgggcctttctaggtactgtatggcaaggaaaatcgagctgtggaaaaaaggaataataaaatttacagaggccaggtgcggttgctcgtgcctctaatcccagcactttggatggctgaggcaggtggatcacctgaggtcaggagtttgagcccaacctggccaacatggtgaaactccatcactattaaaaaaaaatacaaaaactagtcgggtgaggtgatgggcgcctgtaattccagctactcaggagtctgaggcagaagaatcatttgaacccaggaggtggaggttgcagtgagctgcgatcgtgccactgcactctagcctgggtgacagagcaagactctgtctcaaaaaaaaaaaaaaaaaaaaaaaaacccaagaaggtgagggcaaattcagaagctatagagtggaaatatgtaatttttgaggtaaaatttaacaaagattccctgaggaaaagatgtgcgtagggagagaacagcatgatgccagtgaaaacaaactgggaacaggcagttaagcaggatcgaataccatttctttcttaggcgtttctgtgacatttaaagcttatttggttaaaggctttactcagcaaaggatatatctgtgaggtttccacaattttctctatttggattacaattcctgttgttcctggactgcatcttcacatgctaagtatgtaaagtccatgatacctcaagttgtgttagatatcagaaatcctgagtcttcgatgtttagtttgctcttagatatcaggatagcccaccaactctcagtagcttagtgagttaagtcaggggtcaaaaaactaccccctgtgggcccaatccagcccacttccttaaaggtttattagaatatagcaatgcctgtgttttagtgtattatctatgctttcttgctgcagtgtcaaaatttagtagttgtgacaaaaactatggaccacaaaatctaaaatatgtgctttctggccctttacagaaaaacgtgtactaagccttatgttaaaccaaatgatttgtctcccataacttaaaaaagaccccaggtagagcaggacttagacctgcttctgtcaggattccaaaatgattttttttgattctcatatctgcccttctggttaaccctggtctttaggttcaagatggggctagcaaccagggagcacctatcttttcttttcagtcagtggaagggaggtgctctttcatttgtagtgttaggtagtttactactcacagtgtttgtggctcctctggccttgattctcatctacactcaagattagacagctagttgtgtgtccagttcttttggcctttgtgaactatcaagtttcaactcagccaggtgcagtggctcacacctgtaatcccagccctttgggaggctgaggtgggaggatctcttgagctcaggggttcaagattagcctgggcaatatagtgagaccctgtctctccaaaaaaagttttaaaagttagctagccatggaggcacacatgtgtggttccaggtactcaggaagctgagatggagggatcacttgagcccaggaggttaaggctgcagtgagctgtggtcccaacactgaactgcagcctggtgacagagttgagacactgtctcaagaaaaaaataagtttcatctctcccttgcaccatggactcaacttccctattttgagcctccaggagatttttctatcttagcttttagcttggctgcatattaacatttgggagaatttgttatatattatcaggattcctttgtttttgagaaagagggatgcaaagccaaaatcagcggctgaatgacaacacatttaattcagaacttttagggtgtcttatgtcacaaggcatcaatgagaaggaatggaatcctgaaaaatttgggaacagatgagcagattccaacaaagctgagggttttgctcaatctagctgagcatctcttgccgttagaaggagcccttcttcctctatttgaagtcagtctcccttgcctgaaaagcctgtgatgaccttccctgagatggtttccttgcaaaaggctttagatcctcaagacttgcttccactacctctcatttttctagaccaataatgaaactcgggtcttcacagacaatgggaggagtcaccaagtagaaaatacgaccatgaggagatacatcgccaaagtaaggatttttgtaatttatatcaatagaaacctgagaaatagatatggttgtagatcttaccagtgttgaatcaggtggaaataatacaatgatggattaggctggatttgctgatatgggtgtagtgaacagtgattccagacccactgttagcttgagcacctgggaatagtttcaacagttttctcagttgtatgaaacttggatgcaaaaacgttagcctaccctaaagtaaaaaaaagccagaactttgtaagtatgttatagaatttctcgaccttggcacaactgacattttggactggatagctctgttaggggatgctctatgcattgtaggatgtttagcagcatccttggcctctagccactagatgccagtagcacacgtgatgcgcgcgcgcgtgcatacacacacacacacacaaacacacacacctcagttataacaagcaaaaatgtctccagacactgccagacagcagtgcgggggtttggaaattgtccccaactgagaaccagtgttatagaacatatacagagacataggaatgccagaatgctggagtggatgtatgtaaagccttactcaacccttgtactctgggaagattcggaagacactctttgccaaggacttgagaagttcattggcgagaggagcattggcagtttgggagagctctgtagtaactcttctcggcagaccaggaatgggagaggaaaattgtgacattgaaatgggctttaaaaaaaaattcaatgaggatgatgggatcctggagcattaggggtcaagtggaggcactttactggtagagacaaaatgagtgcgtttatcacaatgatcagcaaagtcaaagggattatcagagatctttgcatttgttcatagattgtggtgtccctctggctgaaatagaccagaagcctactgaatccctgcttgatttgaataagtggaaagactctgggtctggtaaatcaacatgagagagaattgtggcctctaaggcaattacataatgtgaatgagttctcattcccagaacaccttgaatgaagtgtaggtcaagtcttcttgagaaagtacactgatacgctgccgaaactgacttatactaccataaatcatcctgcacttctgcaaagtgacttggcaaccatatttaatggagctgtgattaggtaattggaaacagcctgaatatggagggattgattactggtcactagagctgaattgacattaactctgagaaccctaaaatgtcactgtagcccaccaggtagcagaagggcttatagaggatgaataattaatgaatgtttttgcttaggcccgtttgtggtggtctgaatggagccctgaactcatcctctgattatttcccaagtttcagaatgcagaattgcaccagctgcattcaatagctgacagaatcctcatactgaatgttccctgatccatggaaagagggctattttgccaaggacaaacactataaatgctttgtatgtgccaaaaaaaatgataacctgaaagcaaaaccacattcatggaggaattgcagaggttagtgccactagcagtatcttgaaagttgcaagggttatggttctatcacatcctgattcaaccctggtgatcaatagggtgacagatgttgcagccagatcaccttcatgttcatatgctgattgattcactcaattgacgtgtgcagagatacttatatcctagagaattacatgaaattatttgaaatttaattagaaattgacttcatttgcagttccagatgtggttttatttctacagcaaatcaacatgtctgctggcacctgatatagagagccaccaagccaatatgtgcctttttctctatacctgcctgtaaatgtcatccacagaagtttagtttggtagggccatcaatacacttttaaggtcccagctcagttctgtatctactttccagtatttttcacaatttacccagggattggtaaactatgtttcatggactaaatctcctgcaacttgtttttataaattgtctcattgaagcataaccataaccagtttttacatattacccaggagtgcttttatgctaaaatgacagtgttgagtagttaggccacagagatcatgtgatctgcaatgcctaaaatatttactgcccggctctttacagaaataactttctgacccctgctctactctgtagatacaatgctgattgtactttctaagcagaaagaagcaattacaatagacattttggttagaagatggataatacaaaaattcaggagctggccatgttcattagattcctagaggactggccgggtgcggttgctcatgcctgtaatcccagcactttgggaggccgaggcaggtggatcacgaggtcaggggttcaagaccagcctggccaggatggtgaaaccctgtctctactaaaaatacaaaaattagccgggtgtggtggcgggcgcctataatcccagctgttcaggaggctgaggcagagaactgcttgaatccgggaggcggtggaggttgcagtgagccgagattgcgccactgcactccagcttgggtgacagagcgagactccattaaaaaaaaaaaaagatttctaaaggaccagtggtatcggatattccaagatacctgttccaaagtgaagagcaaatagctgcatatgacccttctaaaaccaccagggaagagacacaatgactactaggattcttagtgagttttgtatgtgtgtgcttcactttaaacatttattatggtacaaaaacacataacactaaatttaccatcttaaccatattttatcttaacatttttaagtgtacaattcattagtgtaaattgtattcatattatgcaacagatctatagaacttttcatctcacagcactgaaaatctataccagttagatactatttcctcccccctcctcccagcccctggtaactacctttctaaattttgttcctataattttgactactttagatacttcatgagtagactcttacagtatttgcccttttgtgatttgcttatttcacttagcataatgttctcgaggttgattaatgtcgtgccatgtggcaggattttcttctttttaaaggctgcataatattgcattgtctgtgtacagcacattttctttatccattcttctgtcaatggacagttggattgcttctacatcttggctataatgctgtgatgaatatctattcctttgagatcctgctttgagttcttttggatatatacccggaagtgggattgctggattatccagtaattctatttttaattttttgaggagcctccatattattttccataatggctataccattttacatttccaccaacagtgcacaggtcttccaacgttacatccttgacaacacttgttatttttctcttcctttaccagtgaccacaatagtgggtgtgaggtgatatctcattacagttttgatttgcattttctaaaagattcatgatattgaacatcttttcatgtacttattgacaatttatgtatcttctctggacatgtgtgtttaagaactttgcccatttctttcattggattatttggggtttttttgttgttgttgttatagagttgtagaagtttcttatataatctggatattaaccctttatcagatatataacttgcaattttcctccattctgcaggctaccttttcactctgttgattgtttcttttgatgcacagaagtttttgagtttgatataatcccatttgtctatttttctttccattatctgtgcttttgttgtgatagccaagaaataattgccaaatctaatgttctgaaggttttcctttatattttcttctaggattttaacagttttaggtcttacatttaggcctttaatccatttttatttaatttttgtatacaatgtaaggtaagggtctaactttattcttttgcatatggatatccagttttcccattaccattttttgaagagactgtcctttcctcattgtgtaatcttggcactcttgtcaaaatcatttggttatatatgcaggggtttatttctgggttctgtgttatattggttatatgtctatatgccagtaccacgtcatgttaattactgctgcttttgaagtatgttttgaaattagggagtgtgaggcatctgagattgcatacaaattttagaatttttttttcctatttctgaaaaaaagtcattgggattttgatagtgattgcattgaatctgtaaatcactttgtgtagcatggaaattttaacattattaagtcttcaaacccctgagtacaggatgagttcccatttatttgtatcttcttagatttcttcttttattaataacaatgttttgtagttttcaatgtaaaaatatttcagttatttgattaagttctttcctcagtattttaccctttttgatgctatagtaaatgaaattttcttttcacgttggtgattgctagtatatagagatgcaactgattttttagtgctaactttgtatcttgcaactttgctgagttattagttgtagcttttttgtgtacgtgggatctttctacatataagaccaagtcatctgcaaatggagaaaattttaattcttctttccaatttggatgtctttttaaaaactttctgattgacctggctagaatatccagtactatgtcaaatagtagtggtaagttgggcatccttgccttgttcctgatcttagagtaaaagctttcagtatttctccattgaatatgatattaactgtgggcttttcatatatggctgtcattatatttaggtactttcctttcatttctagttaagtggttttttttttttaatcatgaaaggccctttattttgttatgtggtgtattacattgattgatttttatatgttgaattataccaggtataaatcttgcctgatcatgacctgtgattcttttagtgtgctgttaaatttagtttgctagtgttttgtttaggatttttgcatcaatatttatcagagatattggtctacagtttattttcttgtgtgtctttgcttttggtatcaggttaatgatgacttatagaatgagtttgagagtgttccttcctcttcacttctttggaagaatttaagaagaatttgtatgttaattcttctttaaatatttggtagaattctgcagtgaatccatcaggtcctagagttttctttcttaggaggcttttgatgactacgtccaatgcctcactagttatacacctgttcagttgttttcttaaaatttcttcatgattaagtcttgataggttgcatattcctagtttatccatttcttctaggttatccaatctgttggtgtattcttcttcatagtaatctcttatactttttttatttctgtgacatcagtcataatgtctcctctttcatttctaattttaaatatttgagtcttctctttttcttaatctagctaagaaattaattttaattatttttactaattaatttgtcaattgtgttaatcttttcaaaacagactcttaattttctttttaaaagttattttcttctctctattttctactctaatctttactattttattccttccgctgacttttggtttgcttgttcttcttttcctatttccttaaagtataagcttaggttgttgatttgagatatttcttgtttttaaaggtaagtgtttaccaatataaatgtccctatttggattgctttcactgcatctcataagttttgaaatgttgtatctctgtttttatttgtctcctgatgttttctaaattcctttatgatttattttttggcccattggttgtttaagcatgcattgtttaatttccacatatttgtggaatttcttgttttccttctactattaatttgtagttttattccagtatagttagagaagatactttgtataatttcagtcttcctaaatttattaagacttgtaatatagcctaacatggtctatcttggagaatgtttcatgcacacttgagaagaatgtgcattttactgtcgttaggtgaagtgttctgtatgtatctgttagatccagttggtctttagtgttgttcaagtcctccgtttcctcattgatcttctgtctagttctatccataattgaaagtgggatattaaagtatcctactattattgtgttgctgtttattccccattcagttctgtcaatgtttgttttatatatttgggcactctaatgttaggtgcatatatatttacgtagccctctgtatctgcaggttctgcatccacagattcaactaatcttggatcaaaaatatttgaaaagaatgaaccgttgcatttgtactgaatatgtaccaacttttttgggtgattattccctaaacaatacaatataatgactatttgcatggtattgacataatattaggaattataaatagcccagagatgatttaaagtatatgagaggatgtgcataggttatatgcaaatattgtgccattttatgtaagggacttgagtatccatggattttggtatccacagagtgtcctggaactaatcccctgtgaatactgaggaacaactgtcattgttgtatcttcctagtgagttgaacttttaatcattatatgatatccttctttgtctcttgtgacagtttttgtcttaagtctattttgtctgatataaatgtcaatctaaatagaagagacagagtctctctaaaataaaattacatttattcaggaatgagcatttcaatgggaatacagtgggtatattcagggaggtaaatgaagacaagagttttataaggaaaaatgaaaagggccacataagttgttttgaaacaatttttcttgaccacagggttcagtaacaacggtggtatcagtccaaggttggacagccagttgctgggtagatgtcttcatggaagtagttttgtttgtgtaaggtcatgacatttgagcaacaatggaggtttggagggagtggctcttaggctaggtctacctggagtccgttgttaagttcaattttgtttgttctgtaggtgtgggctattatttcaaagctgtaggccagcattattgtgttaggagttgtacttccacagaaatttgacaggcaacaggtacaaagtttaaaaagaaagatacgaagtaaaatttatactaatatgatcatcccagtttgcataatggtttcgagccatgaacctgggcttaaaggcaagcaactgaatcaatcaaatgatcattgggaattaggtgagacctaatgtaactatgtgcgtgttttcttattttgtgtatttgggtctcaacttccccagaggaatttatccaggtatgcatgtagtcctagcaatagcatagacactaccttatttaaccagtagataatatagaaaaattttgtcatctgatatctcatgactgggttgaattaaaagcatagagtgagtgacagttgtattaggaatatttttaaagttggactaaaggattctttggtcatgtaaagatctacagttggcataacagatctaacattttgtcaagttgtccacataagctactaattgtaaaattttaactacaccattatcctgcccagtgaaaaagttaagcataggcaaggacaaactaagaggggcaacagtctcattatgataaagattgttctggcatcttgagaaagctgtccacagcataaagacatcaacttctcatcctggtttgtagtttgaatgtctctcgttatagcatcgggtggtttggtgaactttctgcatgacccacaaatcaggcatgaggcttgtctcttaaaatttacatcaagttttctagcttcagcttacagggctttaggaaagagtagttcccattcttagtaataacatgggagaaaattagattagggaacctagaataacttaggatccagtctggtctacagtagataataaaaactcaaagacaatgcacagaactacaatctaataacagatgtattatagtccttttctagaaacataattttgtctctatatagttatcctaatttctaccaaagataattacagtaagactgatttgtttgtaaataagtttagttttattattattttaggttcttgtattattttattagttttattattttagttttttaaagtttatttattacttaataatttacataagagcagcaagagtagtaaattgagcacaaaagaatctcagattttattttattttatttttttgaggcggagtctcgctgtgtcgcccaggctggagtacagtggcgcgatctcggctcactgcaagctccgcctcccgggttcctgccattctcctacctcagcctcccgagtagctgggactacaggcgcccgccaccacgcctggctaattttctttgtatttttagtagagatggggtttcaccatgttggccaggatggtcttgatctcctgacctcttgatccgcccgcctcggcctcccaaagtgctgggattacaggtgtgagccaccgtgcctggccaagaatctcagattttaaacctccttgagtctagaaagccaaacaaaggcagacttcagactttgtttgcagtaccaataaaaatttaaatatggcattccagttttaattggtaatacaaccaatgtttttaactgtatcatgttacaaggaggtacagattcatactgaatgtatgcaaataattatattgtcatttaagaaacactagcaaatcacttccaaattttgaagggatcaaatagaaaaaaataaatatttccacctttgttcacagaagtatattttaccaaattgttgtaaactatagatagcttaagagaaaatgtttccttaaacttggaagacaaaacatttcagtaaaaaaccaacaatgtttaaattaaaagttataaaaacattatcagttattcaatttcatgtaattagtttttgttatgcttgatcttgattagcagtttcacaaattcatcagtttcttcactgcagttgtgaaaagttttatttagttcattaatcttgaagttattagaaacttgtatttaagagtacttattagagtcttttccatgaatctgattgcagatacctttagagaaaaatcaaaactatggatgtcaaagacttagaataaccatcattaaaaatctgatgggagttcagcagttgagaaggaaattcaattatttctattgtatttagcattttaaggtaacaaccagaatcgtggttgatagcattacatcaggaccatcagacctttttaaatttcacataatatttaatatacatcaataacatatccatgtaacttaaagaaaatatagcatcactttattatttgacattgattcccatacaattaatcaaataagccaaattagtttaacatctctacaagatgatacctcctttaaggttctccaggggcccaactggaaaatctctcagttaattataggtcaaaaagacttaatttagaactttgatcctggagagacctgccaaaaatgtcaaaatggttaaaacatttaattaaaacagaatcacagattattgtggaataatagtcattcacttaatcagagtgaaaagagattccaaaagcaaatacagaacattacatggattaaaaaaaaaaaccttaattctttcaaagctcctaagtaatgaaaaacctaataaagacaacatgaagcatgagaaattattttgataaaacaaaaaatctttgtttcctaggccagctatcaaaagataaaaaccttctacatatttaaaaaccccttgtgattgcttctccctatgggaaacccatttcaataacctggaagttgagcctgatgaaaaggtacttgaattcaactaaacactggaagagtgtgtatccaaggttatgagtgtaccatattatagaaaagataaacaagaaaacaagtaccttgagcaggcggatatgtggctcttagaaaaagtaaaagaatgtggaatttattggttaaacagcaattcagacacatcaagaaaagacaaaattacagaatcaaattatactggaagaaaatattattcccctagattctcctaggccttaaagacaaacatttttagtgttaggccacaatagcagagtcagaactggagagagagccagagagagagcgagcgagagagcgagagaagcaagaggagtgagaggtgagagagggagagagttacaggagctgactccaaagttgagggagagggttatcatccctaaggagacaaggaagagctgaaggcaatgatgcatgattttagtcgttcacttaatcagagtgaaaaaagcttccaaaaacaaatgcagaactttacgtagatgtaaaaaaaacaaaccttaattctttcaaagcacctaagtaatcaaaaacctaattaaagacaacatgaagcatgtttctcatcaaatcatgtgcaatgagatacagcaaagtggaactgagatatgaatttgaaaagcttcaaaaggaaagttcttttgagaaactaaattactatttttaaatgagggagatagtattttaaagctggaataagggaaattaagtggaaagtgtaaaacaggaaaaagctgcagttcagaagacggctgaaaatttaaacggatttcagaatatcaaaacctcttgcagattttttttaactaaaatcacataaatacatcaagaaaaccttgttgctttaaacataggtgaatggattctggttttgtatcactgtattaatactcaatttttgataaaacctgtgaataattcccttttaactataggcaacttgattaaacacaaattttttccataagattcatcttatataaaaagaaaattgtctgacaaatatatccaggcaaaatgtatgcttgcaattctgaagacctcactattttaacaacaattttaaaatcagtttatttaccaaagatttacctaagtcacacaaatttttaaaagttgggtttattactatttttagtaaatagttatttactattttttctgataaattgcttaattttttttctttacatcagtttcataaagttcttttatatatttctgtagaagaatattatgtatgtataacacagaccaagaaacatacagaaacacaaaaagatcttatagcttatcactgtaaaattgtagtcaagaaactgtaaaatatactaatataaaatcacaagtgtataaaaaaagacagttggatccaaattatatttctgaaaaaatgggacaagttaagatcagtttttcatattgctaatcttttttttttcttttgcctttgataggtaatcttatgagggaagtggaccaaattttgggtaaagctgtttttatagcattttagtttttgaaaaatcttttacccttttttcctcttcaattttaaatgagttgttttaattaacttctggatatttacatttcagttaggattggctagaaaaataaacttccaagaatccttgaacttattaacaaatttaatacaagcaaacaagttagcagattcagagcgagcagagaaaaaaagagagctagcttagaagcccgtacatgttaatcctacagttccagtctcttaattcagctctaaggaaacaagcttagagagtttaaataattcccataatggccgtacattatccttagtgtaatttgccaattattttttaaatgtgcatgagaaaggaccataaatttcaaatgtatagctgcctcaagtgccagagggcttggcattctttagaagttgaagatcccattgcatttcttatcaatctctcaagagcaaagaaaagcccaaaaattttgtcaaaagcattgaccaagctgttttgttttaactagtgtacctgacacagaattcatctttttatacttggcagatggcctttgtcctagttgtctaacctatgaccaagttttccctggttgtgtagaaattttcttgagactggcaggtgcctcagtggtaatcttccttgtctgtgactattttatccttacatgggagacgttttctttggagactggagtccgtcatagatggcagtgacgttcctagtggcatttattattattcttattttgttgttactgttgttgtttagatacaaggtctcactctgttgcccaggctggagtgcagtggtacaatcacagctcactacagcgttgaactcctgggcaaagtgatcctgttatcgcagcctcctgagtagctggggagacacgcgtgcatcaccacatctggctaatttctaaagaaatatttttagagacagggtcttgttatgttgcccaggctggtttggaagtcctggtttcatgtatttctctcatctcagcctcccagctggctgggattacaggcacaagccaccatgcctggtcctagtggctttaattgtccactaaaatcagtttatttaccaaagatttacctaagtcatgtgaactttaaaaaaatgtgagttaactactatttttctgataaattacttaagtgcttaatttttttctttaagtcagttaaatagagctctttcatacattttggtagaaaatattacatacatatatagacacaagaacatacagacaacacaaaaagatattttcccttttccctttaaaattttagtcatgatacattaaaacagtaatatactgtgccatttagaatgtttatttttgctctttgaaagtgttcagaaacaagcagggaaaacaaaagagccaaattatttacagttgcatgtaaccaaattgacatgaaaccaaatgaagcgtgctcacaaaaattttaagccaggcttgcagagcaaacaaaatataaaaccgtgtttgcagaaaaaccaaagcaaattcagtagaaaatacatgcctcacagaacgtaagttctgtgggaaccagagtactctccaaaagaacacttggccttataccagaagaggctttccagaaaagacaaaaagtcttttgtagtcccacaagggttgcaaggtccttaatttaaggtggccttatagccaaatccagatcctgaataaagtcaaaagaacttaccaaacgaaggacgtctgagaatctaagcagagattcaccagagcagagaaggaaggccatagaagcagaggccacaaaaggggtcaatgttggtacctcactagattccaggggatgctggcctgtttgaggtcagctgacttcttgacacaaactttatgtcaacctaaatagcagacacagagagaagatgtctaaaagaaaattgtatttattcaggaatgagtattgcaatgggaatatagtgggtgtattcagggaggtaaagaaagacaagggcttttaaagaagtgaggagggttacatgagttttttgaaacaattatctttggctacaaggatcactaacaaaggtggtagtagttcaaggttggacagccagttgctgggcagctgtcttaaccaaagtatttttgtatgtgtaaggttgtggtggcctttgtgcaaggttgttgtgatttttgcagtctttgtgatcgttcctcttatcaggtatatgtgcatgagaaccttcttttcatcaccttccctggctccatttgtcctgctacggtgacaccagtcttttagtccatacatttgacttcatgaggagtttgctataatcaattgaatgaagaagaaacatgtggacctgctttataggtaattctgcataatgttctagcatcacctaaaaccggacagctggcacacttacagcctcaggctgtggtggccccaaaggagagtggtaaaagaaaatattcccatttgttagaattttgagtagtgtacttcatagtttttttttttcccagaaggaatgatgccagggggatgaatagttttgctggatggtcatggacttcaaagaagcatgattgataattggttgacaaggcaaattgacaatgaggtatgtgagtggactacttttaatgagcagaatataaaattacttgcggcctatttaattgtcaataatcagcaacctcaccagaagatgagcttaataatcaggtgatcaagatggtacattctgtgaatattcttcaagatttttctctagtcaaccatgtccattcccagtgggtgcatgaacagtgtagtcatggtggaagaaatggagcttattagttcagtactatgaaattccatttactaaatccaatctggctacaaccacatttatatggccaagctatcaaaagtatggactaacactggacctcagataggcactgttcttcaaaggggactaccaacctcctgctggaatttgattacaccggaccactttgatcatggaggagacagcactttgttttcagtggaaaagacaattactctagatatgaatttgcctttcctattccaatgtttctgataaaagcatcacatgtggactttacaaaatgttttattttctgccatggaattccacccagcatttcttgtgaccagggcagtcatttttcaaaaaatgaattgtatccattgggctcatgttgatagaattcactaaacttaccatgattcctgttaacagttccatttcagtagtgggacatgcctcaattctcagaagtcctaccatctctgatttgtcttcccatgtttgtttacctaattcctactttaaaatgtccttgtccctaaaatcctagtgattctgcttctctgattgaaccctgactgatattgaaccatttctgctccttttcagacactacccctctctctcaactataatcactttcctaacttctatcaccattgactacttttccttttatctttatatatatgaaaccatattgtatatatccttttgtgtctctgttttgcccaacattatgtttgtgagattgaactatgctgctgttttatagcaattgtttacttattttgttactgtagagcaagtgtaggcacactacatcccatgggtgaaatcttgtatatatttcggggtgcacatgtgtgtgtgtttctgcttgctagaagtggaatttctgtgtcatggagaatacataaatttaactctagcagatactgtgaaacattttccaaagtgattgtaccaatttacactcttacaaggaccgtggtagagttccatctgctccacgtgcttgccaatgtttggtgttgtcagacttaaattatttttaaattattttttaaattcaccattctaattttttaaaagaagtagagtataatgctggttaccaggggctggagtggaggggttgggacatattggtcaaaagatataacatgtcagttatacacgagtaatttttaaaaaatcagtgattctggtatggcaatagagttgtctcattgagggtttaatttatactgctgtaatgactaatgaagttgagcaaacagagcatgtatctgaagccttgtacatttgtatattcttcatatagtgcttactcaagtgatttgttgatttgtctatttggttgtcagtcttattcttgtatttataggatttctttatattctgcttacaagccttttgacatatgtgtgtattgtgattatcttttcaactgtggccagcattttcactttccttatggtacatttgataaacaaccattctcattttaagttttttaattttacttttcagttggtactttaaaaaatcgttgccaacattagagaaggtcacaaagatattttagtagctatttaaaaaaatcttttaattttaagatctatattccatatcatattgatatttacatatgggatgtgctaaaggtcaagattaattatttttctatgtgaagaatatacaatatcctcacttcttaagagatttctccattttattatctttgtcaaatatcaaatgactagatatatgtaaatctgtttctgaactttctattatcttccattagtctattcatatttgcatatatagcacacttttaattactgcaaatacataaaatgtcttgatgtcttatcgcataaacccacctctttctattttcttttgatgttttggttattcttgactgttgcttttgtttacagattttagactcagcttgccagttttcaccaaaaaactgctgagaattttattaaatatatagattattcaaaggagcactgatagctttacaacattgaattgtccagtatctgaatagcaccacatattttaaattttcattgaagtataaatatatgtagaaaaatgtatatgtcatatgtgtcatgattgtttaattttcaacacactcaaaataccagcatctgtatcaagaaactgcacataaccagcatgtggtagccatgaaaatgtatttcacaaatattttaatgcaagtaaccaaagacccctattgttgtgttttaaggtcaatcctgtgtttgcatcaaggccagattttctgaaggctgctgctcccagtcaatatctgagagcagtaaggattctaaggtagacctgttcagggagacatggatcttctctgttggatagataagattgtgaatacctgactttaatggctttttctttaatataacttttctttcttttttttgaaatttagtctcgctctgttatacaggctggagtgcagtggtgcgatctcggctcactgcaacctccacctccagggttcaaaggattctcctgcctcagtctcccaaatagctgggattacagacatgccaccacacccagctaatctttgtatttttagtagagacggtgtttcaccatgttggccaggtgggtcttgaactcctgacctcaggtgatccgcccgccttggcttcccaaagtgctgggttacaggtgtaagccactgcacctggcctaatgtaacttttcttaagctgtatggaagtctagaatgattttatcaaatcttcctttgttgttgtgttgttgttgctgttgttgttgttgagacagggtctcactctgtcacccaggctgaagtgcagtggcacaatcttggctcactgcaacctctgcctccccggctcaagtgatcctccagcctctgcctcccaagtagcagggactacaggcacgtgccaccacacccagttagtttttgtatttttttgtagagacagagtctcactttgttccctgggctgccttttgttctttactcagtgttagatttacatcatggtgcagcttctctcctgttttctctcacaatcatttcccctaataaaattcttacacaactaattctgcctttgcattttttttctttctttcctttttatttttcttatttatttatttttttgagacagagtctcactcttgttgcccaggctggagtgcactggcgagatcttggctcactgcaaactccgtctcctgtgttcaagtgattctcctgcctctgcctcctgagtatctgggattacaggcatgggccaccatgcccggctaattttgtattttttgtagagatgggtttctccatgttggtcaggctggtttcgaaccccgaactcaggtgatcctgcccaccttggcctcccaaagtgctcggattacaggcatgagccacttcgcctggctgcatttttatttctaagaggacctgcattagcacatcaccctaaaaacgttcgtgcccaattcaaattcctacttttctctcaaggtaggcactgttctgatttataatagcatagatttgctttgctattttttatacttcatataaatagaaaaaatatgtacaattttgtgttttatttgtccacattatgtccgtgacatttatccatgctgttggaagtgaatataactggtttactctcattaatatgtattattttaatgtataaatatcacataacttattaattcatttaatcgttgattttgtgtagtttcttgtccttggttattaaaatcagtgcttgtaggctgggtgtggtggctcacacctgtaattccagagctttgggaggctgagatgggcggatcacaagttcaggagttctggatcatcctggccaacatggtgaaaccctgtctctactaaaaatacaaaaattagcttgacttggtggcatgtgcctataatcccagctactcaggaggctgaggcaggagaattgcttgaacccgggagacagaagttgcagggagctgagattgcagcactgcactctagcctgggtgacagggcaaggtttcatctcaaaaaaaaaacataaataaaaaatgaataaaataaaattagtgtttgtataaacataaaaagacatgtcttttgctgaacatatgaatctccttctattgataatatatatataagcatggatctaagggttatacgacagttttagtaatagcactgaaagttttagtggtagcactaaaactactcagcttcagtaattactgcaaaactttattgcaaagtggttgtataaaactacattcctacacgatgcaagtatttgcatttttgtcaacctttctttgactaattcttaattttaacctttatggttggaatgtagtggagttctcataatattttgagtttctttgatgactcaagaacttgagtatctttttatttgattattgagtatttatgtcatcttttctgaactatctgttcagttatttttacatttttctgatttgtttgcctgacttttcttacagattttaggatttacgtattcttatatgctcaggatatgaatcttttgtcacatatatggtttacaaattttctcaatttgagaattaccttttcattttctcattggtgccttaattaagagaagttcttcatttttaaaataatctaagtcacctaattttttaaaaattgtggattattttggtctcatataatatttttttccacttcagggcaacaaacaggttcttttgtttccctaagtgtcattgctttactttccaaaattagatctgcattttttctgaaagttatatttgtgaattctgtgaagtacagacgaatatatattttcccatgtggatatctaattgatgaagaagcacatattaaaaagaatttttataatctgtacagtagcatattcttttcacaaatgaaatgacagtatttactttgatctacactctattctcttcctttatctatatatctttaagcaaatgccacactgatattgtagctttataatatgattagatatctcataaagtaagtcttccattttgttattctttcacattatcttgactattcttagctctcagattttactccaaatttttataatatttgtatcaatttccagaaaaaattctagtatttttattgggtttgcattgatatgatggattactttggtgaagaatattgagatgtttaaaatattaaattgtctatccataaatattatttattataattattttaaaggttttttgtatatgcaggaaaataaaagcagatctttacctaataatatttacatagatttcaaaaggattaaagggcctaaatgggaaaggtaaatgtagaaagttaatttttttaatgtaggagaatattcttgaaacctaggactttcaaaagcacagaaattaaggaaaatgcttattaaatttctctcctcaaaattaaggatgcttattcaatgtgagacacagtatatgaatattaaaatcaagtacaggtgccaagacaattcaatgaaaaaagaacagtctgttcaacaaatagcaaatagtgctaagaaaactggatgtgcacatgaaaaagaatgaagttggaccccctactttacatcatatacaaaaattaacttatagtgggtaaaaggcctaaatgtaacagctaaaactataaacaactagatgaaatcatagatataaatcttcatgaccttgaaataggcaatggtttcttagatatgacatcaaaagcacaaggaacaacaaaaaataaatgaatgaattggaactcatcaaaatgaaaaacttttgtgtatcagtggataccatcgagaaagtgaagacaccaacatgggtgaacgtatttgtaaatcatatatctgatgagacttgtagctagaatacataaataactcttacaattcaacactttagaaagacaaataacccaattaaacaatgggccaaagtatctgaatagacatttttcaaaagaagacatataaatgcccaataggcacatgaaaagatggtcaatgtcataagtcattagggaaacggaaatcaaaacaacaatgagatattgcttagccaccagattggctacagtaaaaaagacagataataaaagggttgccaagggagtggagaaattggaaccctcatacattgttggtgggaatgtaaaatggtgcaatttatttggcaaacagtctggcagtttcccaagggtttaaacatagagttattatatgactcagcattccactcctagatatacaaccaagagaaattaaaacttatgcctacacataagcttgtacataaatgttcaaaacaacattattaataatagccaaaagtagaaacaatccaaaatagccattaatgaataaataagatgtgatgtattcatccaatggcacattatgtagccatgaaaagaaatgaataactggttcatgcaccaacatggatgacccttcaacatgttatgctaagtaaagttcgtttcaaaagaccacgtattgtgtgagtacactgacagaaaatgttcaaaatatgtacatctacagaaagtagattagtgattgcctagggctgaggagtttgggaaaaattggaagtgactgttaatgggtatcaggtatctttttgagattatgtaaatgtcctaaaaattgattgcagtgatagttgcacaactctctggatataataaaattcatttaactgtgctctttaaatgggtaaactgtatccattatatctcaataaagtttctataagaaatatcaaaaaatagctctccctctccctctccctctccctctccctctctccctctcttccctccccctctcccccctccctctcccctccccctctccccctctccctctcccctttgcacggtctccctcccatgccgagctgatacgaggctggactgtactgccgccatctctgctcactgcaacttccctgcctgattctcctgcctcagcctgccgagtgcctgggattgcaggcgtgcgccgccacgcctgactggtttttgtattttttggtggagacggggtttccccctgttggcccccctggtctccagctcctgaccacgagtgatctgccagcctcggcctcccgaggtgctgggattgcagacggagtctcgctcactcagtgctcaatgttgcccaggctggagtgcagtggcgtgatcttggctcgctacaacctccacctcccagccacctgccttggcctcccaaagtgccgagattgcagcctctgcctggccgccaccccatctaggaagtgaggagcgtctctgcctggccgcccattgtctgggatgtgaggagcctctctgcccggctgcccagtctaggaagtgaggagcgcctcttccctgccgtcatcccgtctaggaagtgaggagtgtctctgccgggccgcccatcatctggggtgtggggagcgcctctgccccgccgccccgtctgggatgtgaggagcgcctctgcccggctgcgaccccgtctgggaactgaggagtgtctctgccccgctgccaccctgtctgggaggtgaggagcgtctctgacccgccatcccgtctgagaagtgaggagcccctccgcccggcagccgccccatctgggaagtgaggagcctctccgcccggcagccgccctgtctgggaagtgaggagcatctccgcccggcagccaccccgtccgggaggtggggggcagcccccgcccggccagccaccctgtccgggaggtggggggggcgcctctgccccgccgccccgtctgggaagtgaggagcccctctgcccggccgccaccccgtctgggaggtgtacccaacagctcattgagaacgggccatgatgacgatggcggttttgttgaatagaaaggggggaagtgtggggaaaagaaagagagatcgggttgttactgtgtctgtgtggaaagaagtagacataggagactccattttgttctgtactaagaaaaattcttctgccttgggatgctgttaatctataaccttgcccccaaccccctgctctctgaaacatgtgctgtgtccactaagggttaaatggattaagggcagtgcaagatgtgctttgtgaaacagatgcttgaaggcagcatgctcgttaagagtcatcaccactccctaatctcaagtacccagggacacaaacactgcggaaggcggcagggccctctgcctaggaaaaccagagacctttgttcacatgtttatctgctgaccttccctccactattgtcctatgaccctgccaaatccccctctcggagaaacacccaagaatgatcaataaatactaaaaaaaaataaaaataaaaataaataaattaaaaaaatttaataaaaaacaatcaatacatcaaaaaaagaaatatcaaaaaataccaaatagtaggtattgctgtgtctcaaatgcataaggtattaatattcgtggtatataatccaagtgaacaaggaaaatatagcacccataacagaagaaaagggcataaatatacagtttacagaataggctgtaaagtattttgaagaaatgctcaaacttattaaaaatcagagaaatttgattaaaacagtgaaataccagtatgtgtttaatggagtggcaagacataggatgatggttcatggcaaatgatggtatggaaatgggtggttatacaacaaactgtattcagtgctcatgagaatgtggaatggtttaaccattcaggagagcaatatagctattaatattatttgtaaatgtgtaagtatatgactctgctatgaaccaacaactacacttatggatatgtgtcctaaataaattgtcacacatttctatgaagatgtatagtgatgttcctagcattgttattgccaatggcaatccaggtttctgtcatggaatagtaaaatattttgggtgtaaacaattagttctataaaataggttaatgtatgctagaaacatggatgaatctttaaaacatactgctgagttttgaaagtcttaacatttatttttatgacataataccacttatataaactaaaagtgtgcacacacaaccacatcacatgcactttgcacaaaacacacacaaagagaaacacaacaaacaaaatatggggctgggggaggaaatgaaagtgttccatagggaaaagaaaggaataaataaataataaaattattttgaccaagttgctagatataagcttcagtacaatttgattagaagtggtgatattcagcattttcttcccattctcattctcagagataaattttcaacattttgttaattgttgtgtatgttcattttagttttaagtgggaatttatatttcttaaatgtatcatcataatgttcctcataatattctcaatatatttagtgatgttcccttttacttctgaaactggtaatatgtcatttctgtcttttttgtttactgtcactggactttgtcagttttattgttctatttatagaatgatcattttactttttaagatccactccatttcgttttctatttcatgtatttcctattatcttgatcatttctttccatctacccactgtggttttggtatttgtttattgaattcctgagataaatgtttttatttttttgttcagcttttctcctgttttaggacagatgctcctcaacttacagtgggctcacattctgatgaacttacctaccgtaagttgaaagtatcctaagtcgaaaatgcatttaatacacccaatctaccaaacatcatagcttaggctagcctgccttaaaggtgctcatgacgtttatattagcccccagttgggcaaggttttttgttttgttttgttttgagagggagtctcgctctctcgcccaggctggagtgcaatggctcgatcttggctcactgcaaccgccgcctcgcaggttcaggtgattctcttgcctcagcctccagagtagctgggactacaggtgcgcaccaccacgcccgactaattttcatagttttagtagagacagggttttgccatattctccagggtggtctcaaactcctgacctcaggtgatccaagggcaacgttatctagcaaaaagaagcttatttcataataaagtgttgaatatcatataatttattgaataggtattgaaagggaaaaacagaagggttgtataggtactgtactgaatgtgtgttgctttcacaccatcatgaagtcgaaaaatcttaagtgaaccattgttaactccaggacctgtatatgatttcaaggctttctatgtttccttctaatcatgtattaaaagctctcctgtttatcagtgtttttctccttatgagtctgtcaatcaatttttctttataaagtttgctttacattatgtaaggctgttatagttgatagaaaattttcattactatgaagtgtttctttgtatatcttaaaatgttcttttcttcaaggactattgtactttgtccaatattaatatattttaaaattagagaaagaatatgaggcctaggacgatagtctctttctccattagaatatttttgtttatgtcaggtacctgcaaacactaacagaaaaggtttactttaatctattttcaggtacgaatgtgatttcaagttttgcttcagtcccctagtgaagatgatctatttgccctttatctttactcctgtagtgcagctctttgggttttactaggtacccttctcccgatccccaacttcttccccaaggcccttgaacaacagaatcggtaggtaccaccaagacagacacttccactctaaaattgcaaatcttggctaagatttgctctggctttctaggatacccggaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggttgtcgcttggttagagggtctcctggcgttccgcagccagcctctcccacctacttgccagctctgccacttactagtgttataacgttttgtgagttaatcttaatctttctctatcccattctcctcattcctgaagtagagtcattagtaggaggtccttgtacttttatacgaattattcattaaatgtccaaaataccgttatgtggtaggtaccacttatgttctaacagagagacgaagataatagacctctccacacaatgtagaaaagaaagctgtcttattactgaataaggacaaccactgtatagtattgtaggcaatctaaagaaaaatattattaaaaaattccgccctatgtgtacagtcaagcagttttaaactttttatacaattctacttttgaccactatgtacatcagttctcaagattaatgatttttcaataagaggacttggtctcatcatttactgcaaattcttttataaatttattctaaatttacttgagaatccagtgttagttaactaactttatcgaaagtaataaaacttctcttacctcatctgctagccgatttacagtttaaagagaggcaccttggttaaactcttgcagtgatagggacagtgggttgttattttctcagatgtttatattcaaaagggacaaatctcagaactttcacaaatacttctaggttgtaaacctggctagaggcttacatagccgctaatgaaatttacatgcgtatcaaaaggttagagaaaggattcagaagcactaggtttcttatggaaatgctctaagaaaaagaagagggaagacgaaccctaaaacgtacagttagtaagaggcagaacgtccatatgaacccaagaagttggagcctcaagtctgtgttcatattctccacgctgtacatttttcttagaaccatatgaaataatcgtgtatatggtttgtggaagtctttttctatcaggtttggaaggtgatctggggctttagagtctatattctccttatagaaataatgcatgaccattatagagagattagaaaatacagaaatgtataaaaggaaatgaaagttacccatattcactgctgtatatttaaacaattagctgggtgtggtggcacataccgatagtcccagctacttgggaggctgaggtgggaggatcgcttgagctcaggagtttgaagctgcagtgagctatgaccacggcactgcactccagcttggatgacagcgagaccccgttcctttaacccataatctcaggatttagagataaccactgctaacattttaaatgcatttatgcattggtgccataccacccacatggtatttctctaatttttcttgtagaaattcccaaacatgcacatacagaaaatagtgttaatgacccccaccccgccatcatttgtctttaactcttgtaaacattttgtctatcttattgcatctattactcttctcccacatatgtttttggtgggaagaggaggaatttgactatttaaaatcaaaaccaaatcctagtcagtcggtagaaattaaaagtaattaacataaagtaattatgaatgaagagcaaaggaaagcaaataacttcagggttttctttcctggcaactaggaggaaggtagttatgtgaaaaacctaaaggagagggaatcattgagatttggaaaggaatagttatgaatttggcttctttatttggaatgttttactcagggtcttttatttatttatttatttattcatttttatttatttatttttgagacggagtctcgctctgtcgcccaggctggagtgcagtggcgcgatctcggctcactgcaagctccacctcccgggttcacgccattctcctgcctcagcctcctgagtagctgggactacaggcgcccatcaccacacccggctaattttttgtatttttagtagagacggggtttcaccgtgttagccaggatggtttcgatttcctgacctcgtgatctgcccacctcggcctcccaaagtgctgggattacaggcgtgagccacagagtccggcctactcagggtcttttagatctgatctgtttctcccttaggctgcatgttactttgttgcaggaactatgtcccattctttaccatgtgcttagcacccagcacaagactggtaaggaggggtttagtgtttgtggtttgtggagctgcccagtatcttgaaatggaaacctgcagatcatttagattgtattcagaattcccaaaatggatttaggaaaaaataaaaggaaataatgtcaatattagtgactctttatctcacttttggtgggatgcatttgcatagtcttctagtttttttcccagtaatcaaaagttgatgcatggttattgataatattttagtgatcaaagcaaatttttgtagaaaccttccatccataatttatgtgtcctgtgtttatcccctgaggttaacatttgctaactttttatagggtagtcatgaatcaggcagaatttccagtgttttacatgtatttattcatttgtacttgatatcaaccctattatagtctccattttacaaatgaagaaaaaggggacagaagaaatggaagcactagtattttaatctagatagctttatactaaggctgtaatattagctactacacactacttttattagtctacaaggcaagaacccacagtaagtcttattagagcagggaatatttaagctatggatgaagaccgtcacccaggagggaaaagagtagcaggttatgacagaaggaacaccaaatacaaagaattagaggctttttgtaggagtacaagtaatccactatggctggacatgtagagtggaaagtggattccaagagagaaacagcatctggaaaattcctgtttgtgcgacttgttaaagcatttgaaccttctcttaagggcactggatagacatgcaggtgaaaataatcaaatttccatcttaggagatatacttaacctctctctgcctctggatcccaaagagtaaactagaggacattatttgttttaaaaaagttgtgaaaatgggctaagtgtggtggctcatgcctgtaatcctagcactttgggaggccggggcgggtggatcacctgaggtcaggaattcaagactagcctggccaagatggcaaaaccccgtctctactaaaaatacaaaaattagctgggcgtggtggggaggggggtgcctataaccccagcgacttgggaggctgaggcaggagacttgcttgaaccttgtgtgagggcggaggttgcaatgagccgaggtcatgccacttcactccagcctgggcaaaagagccaaactctgtctaacaacaacaacaacaacaacaacaacaaaacagaacaaaaaaaaaaagaaaaaagttgtgaaaatgtagtgagggtcccatagtctgaatagtttgaactagttcctggcacatacttggttctttataagagatagttgtatataacagaataaagaatatatatttagtaaatgagaactgcaaacatgtactgtagtagatatgtggatatttttaggtattgctctcttctttcaaccctcaattcttggaaacatcaattccattatacatttaagcaaataaagatcaaggtttaaacactgaagtaataaatttgttcatctttcaaattcagaaactccttgaggaatgattacagaggccctagttgctttgtggagttgatctaccatatgccaaagcttgtgttttctatgtctagctatcctcagtaagcaagttgttctgaattatatgactgtgctattaagaaaagtggaaatccataatatattctgccttcgttgcattttttgattgctctttcattcttttagtatctaaagagtagtttttctattagtcgatcctgttaaatgtaaaaacttaaagggtttcctctgccctttttttttttttttttggaagtggtgggtataattctattagtacaggatcacgtgatctgtttcttataatagttttttttttcttttttttttttttgagacagagtctcactctgtcgcccaggctggagtgcagtggcacgatcttggctcactgcaccctccagggttcaagcgattcttatgcctcagcctcccaagtagctgggactacaggcgcgcgccaccacgcccggctaatttttatatttttagtagagacggggcttcatcatattggccaagctggtctggaactcctgacctcgtgatccgcccgcctcggcctcccaaagtgctgggagtctttttttattttagggctccaattcttcacatatttgctgttactttttgttaataagaaaaacctaaattccactgacatcagagaactgcttcagcctggctaaacagcaataagccgtgaagaggattctggatgttgtagtccgggagctccgagaattttgtcacactctccgtaaccctctctcactcgctcgctccgtttttttttttgtttttttttttttcaagcgcgaagagggcggcacctggatggtttttccttctggaagttctgggaaacgtattccagaactctgtccggaaacaattgggccgcaggagcgcgggccttctgggaagggtagttcaggagctctgggcaggcagagccacttccgccccggaaagcgaggccgccaccatcttttgggtccgggaggtgagtcagccctgcacccccacgacccctcttgaaccttttcagcctgtgcttgggaataggcgctccccagccatcagtcttgggatggagaggtcgcggccgcggcggaggccgagaggccgagggcgggaagtttgctctcctcccgcacttggcaagcagcgccgctagttctgtgggtataataaacagcgagttacctatgatccgcgctcctgtttcctcatctttaaaatagcaataaagatagtcgttactgtgtagggttgtaattagaattaaacaagataatacgggtcaaaccttagaacagtggtggcacctgatactgggttggctcctgctattgatacagtgattccctcacaagcgccctttttactggaagctccagtgaagagagaagaaaagtcagggctttatgccatggcctttctgtcgtatccttcaggagaccgagctcttcccgaacttttacagatcttttttttttttaagaaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccaggtacctgctcttgaacgcactttgttgttccattttctgtcctttcagttaatcaagtttccgtcactcagtaagttactactgaaaaatgatgaaatatttgttgaataaatgtgagagtgggtaggaaaactacttggaaatgagtattaccaataacatcttaccactttgattttaaggcattcgtctgtggaccatagctattgatgaagtaggtcttgttattttgttatgaggaaattaggcagagtttatgttattaaatactttcccgaagttattcaactgatagtaagaggtggatttgggattgaacccaagcattccttttcagactgtgtgatcttttttgtttgtttttgtttctttggtttttgttgttgtttattttctattcctttttctgagtctgtggtcttaatctcaatgatacagtcgtcttcagttatcttaaatagtaatccatatggctaccggtgagtcgttggaaatcagccttgggaatgtaggtatggattttactgtggaagacctcaaaaactgcactgatgaattttgaattttttagaaaaatcctgcaacatctcacttacttaatttcattccatgtcaaaatatgtcatattctagttatagaagtaatgaatgctcattatagagatgcactatccaatccagtagctataagccatgtgtgccctaggagcacttgaaatgtgtctagtccaaattgagatgtgctgtaagtgttaaatacacactggatttcaaaaactttgtacaaaaaatgtaagatggctcattgataattttttgtattatatgtcaaaatggtaatattttggatacattggcttaaattatgttgttgaaattaacttcacctatttttgtttttgtttttttgccttttttatatgttactgctagaaaatttaaaattatttatgtgtctcagtatatttctattggacagtgatgttatattcagaaaacttaaattacttataataaaactgctaacactttaatgtgtttccctttagtatatgctatggatgtttctcaaaataggtttggtattctgtgtagtagtttttttcttattatgaaaattttcttttttctttttttttctttttttttgtgagatggagattcactcttgttgcccaggctggagtgcagtggcgtgatctcagctcactgcaacctccacctcccaggttcaagtgattctcctgcatcaagctcccgagtaactgggttacaggtgtgcgccatcactcccagctaatttttgtatttttagtagagacggggtttcaccgtgttacccaggctaatcttgaactcttgacctcaggtaatccgcccacctcggcctcccaaagtgctgggattaccggcgtgagccactgcgcccagccgaaaaatttcaagcatattcaactgtcaaaagagtggtgcagtgaattccacgtaaccaacactcaggttcaacatttgctgcagaccatctcctcctccttccaccccacttttttttttttttttaaattagagtgtcttaaagcaggagtcccaacttctgggcagcggacctggtactagtctgtggcctgttaggaacctgacagcacagaaggaggtgattggaggggtaccgcctgagctctgcctcctgccagatcagcaggggcattagattctcataggagggactgcacatgtgaaggatctaggttgtgcgctccttatgagaatgtaactaatgcctcatgatttgaggtggaacctatcatccccaaaccatctcccccgcccccatccggggaaaaattatcttccgtgaaactggtccctggtgccaaaaaggctgcagatggttgtcttaaagcatacgccagacatcaggtcagttttttttttttttttgaaacggagtctcgcctgtcgcccagaccggagtgcagtggcgccatctcggttcactgcagcctctgcctcccgggttcaagcgattctcctgcctcagcctcccgagtagctgaggtcagttttttttttattttctaccatgacctctgaaactgaagctgtaatttgccatttgctcagtacagtatatcttttttttgttctttttctttcaaacttttttgtcattatgttttcgtagtgtcttttagaatatatatgtataatttttttttttttagtgcagtctgggataatttgcttttactatctgtgtgtatattttgttctcctttcttgtctttttttgttcagtttattcccttttatttgtgctcaactggtctggagtttatatggttttgtgtcattcttctaactttaaaaatattctctttcttagcaaatactaaacttaatcagcatgtgttcttattctgaagaatattgagactaaaaaaaatctgaaagaagatggggccaggtgcggtggctcatgcctgtaatcccagcacttggggaggcctaggcgggtggatcacctgaagtcaggagtttgagaccagcctggccagcatgatgaaaccccgtctgtactaaaaacacaaaaattagccagacgtggtggtgcgtacctgtaatcccagctactcaggaggctgaggtgggagaatcgcttgaacctgggaggcagaggttgcagtgagctgagattgtgccattgcactccagcctgggtgacaagagcgaaactctctctctaaaaaaaaaaaaaaaaaaaaagatgtacctttaaaaaaaaaaaaaaaaaagctatgtttttataggtctactttttattataaccaccctcaaaatttgtcattatagttctttggctttttttaaacaaagattattatattaccaatatagtcacaaatgttttcttaccattgctttttgcagtccatcttttagggttcacatggttataaattctcttcattttttttttcagctaaaatattgtttctttctcatgtaaataatcatctagttgaacatagaattcaggttgacagtttctttattttggaggtaatattcatttgttttaaatctccattctgttaccctatttctgtcaatctaattgttatttcttttaggtcaactatattttctttctaggagctttaaggttgttgtttccagttctttatgttcgtttagtcttttgcatttctgagttttattgtgatttgtttagggtatgtttatttttatttatactgtttagaatttctatatgcgaacttgtatcttttaccaattgtgtgaaattctcagcaattgcatcttgaaattaaaacctctcagtcattccctccatcctgccttctcttctcccattcctgttagacaaatacggaagcctctcaatttatctttcatgtttcttgatttttcgtttgtgctttatctttctctttgctgtgtgtttttctctgtgcacataaaataaaagagatgtaccaatgatcgtttccaggcttcatgaagtaaattgacccagaatgatacgttttagaaaactgataacagtgtcagtaaaatattactagctgggcaacaaattactaaaaagaaaccttaagtcagatttcggcttttcagaaattaaaggtgactttcataggagagcaatatttgcaaggcaagtgtgtgatgcaaagtatcatctgcttgttttttttttttttttttttttgagacagagtctcactgtgtcatccaggttggagttcattggcgtgatcttggctcactataacctccaccttccaggttctagcaattctcatgcctcagcctcccaagtagctgggattacagacccgcaccaccacgcctggctgattttttttatttttggtagagatgaggttttgccgtgttggccaggctggtctcaaacttctgaccttatgtgatcctccctccttggcctcctaaagtgctgggattacaagcatgagccactgtgccaggcctggctaaacagcaagaagccatgaagaagcttttttgtaactataagagaaagggactcctggttcttagaactctccatctacttatttaatccttggaaaaaccctatgagggaggtacgatttatgattcttaccatatcctcattgtacacataacagaagtgaggcacagagagggtttttaatatccccaaggttacacagctggtaagtatcatttctaggaattaaacccagatacttgacttgagagccctcatatgttgttacattgcctctcgtttcctgctgtctctgccatcagaaatccttgtagcaaggatgctgcacttgtgcagactgttcactgcccaatggcactgaactatcatgccatttagtagctggaatacagtccatgttctgcttaccaagctgtatgtggctatacctgtctgaatgtagggctatttctctaatttcctcatatgtacacatgggctaacagcaggcttgtgtctcatggcgtctttggtctcccccagttatgccatctcagaactatgaccttccccagaagaagcaggagaaaatgaccaagtttcaggtacgtaaaggattccttgctgtcttttaaaatgtgatttatttctcaaagataacagatttattttttctctttcttggaaaggttagtgggaaacagatattcaggacatgtggtatgctgacatgtatgtgtttttttgttttagtttatcacctttactattttacaaaacagtgtttgaaaaaataatagaagctttaatcagaaataatctatgctactaccctgcttatgaactagcttttttcattttcccatgttcctttttcatacacattttgcaatacttgagtagatgaaattttcaattgtgcattctccacttaattgcatcacctgcattgtaagtgagtacatcatatgccattgaattgcagtgcccttaaaagacaacaaaaactatttcttatttagcctttcagaaattcagaaattttaagaattttactactttaaagtaaatccagtgacttttttccctacatataaaaacaattccttcaaaagaaattctggtggaattcaatattatttgtccttaaagttttaggaactctgcattgaagaggtttatgtctcagtttcatgtcagttccctcaggtgttttgtaaacagaacatctaaagaatgacatggtgtaattttattagatgctttcagagaagaagagctatatatttttcccgtttatgtttttatcactcatttatttcttgtatgaatttatttcatcaaagtaactacatgtacgtaaggtctagtagtacttagatgtcttgctagccctttccatctgtcattgcatttttcagatgtgaggatggagatgatttatttgcattttaaatatgaagaaacaggttatgggaacattttataactgccccaaatttcccaggtagctgactcattggacactgaagcttccaactattaggaatatctggcattctattttcatgtaaaggcagacagaacaaaagagttttccattcacagagatgagcacatatgatagaagtacctgatgttacctttttattcttttgagacagagtttaattcttgtcacccaggccggagtgcaatggcatgttcttagctcactgcaacctctgcctcccaggttcaagcgattctcctgcctcagcctcccaagtagctgggattacaggcatgtaccagcacgcctggctaattttgtatttttattagagacggggtttcaccacgttggccaggctggtcttcaactcctgacctcagatgatccacccacttcggcctcccaaagtgctgggattataggcgtgaaccagtgcacctggccctgatattaccttttggaggatagaccccaacaatgcccctcatccagtttccatctcaattactgtctcttctctagttttgtctcttagtcattccatgaacgtagatgctcaagcacagtttttatgtaagtgttttaaatttccctacagcaaaagctatcaggtatgatggtaagagacagcagcaaaccggtggcatatacttaaacattaggtaaaggtctaatagcttaaattcctgttaagattagtaatatagagaaaattccaactggaatatgagcaaaagaaatgaataggagtgtcataaagaaaagaaatttatgaaaaaaacttcactaataatttaaatgtgtgaaaatgttaataaaatagctttctatttatatattggttttacttatattgtcaatgacttttttagaaaaaggaactgagtcctatttagccggggtctagagattcaggaatgcttgtactgttgcatgaagagtgaactgggaaaatctttggagaggaaaatctgccattacgctttcaaaacttttttttttggatgttgattttcttttatttatttatttatttatttatttattattattatactttaagttttagggtacatgtgcacaatgtgcaggtttgttacatatgtatacatgtgccatgttggtgtgctgcacccattaactcgtcatttagcattaggtatatctcctaatgctatccctccccactccccccaccccacaacagtccctggagtgtgatgttccccttcctgtgtccatgtgttctcattgttcaattcccacctatgagtgagaacatgcagcgtttggttttttgtccttgcgatagtttgctgagaatgatggtttccagtttcatccatgtccctacaaaggacatgaactcatccttttttatggctgcatagtattccatggtgtatatgtgccacattttcttaatccatctatcgttgttggacatttgggttggttccaagtctttgctattgtgaatagtgccagaattaacatatgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttgctatttctccacatcctctccagcacctgttgtttcctttttttttttaactttaaaaaaatgttaatagaaaaaaaatgcccagataaagataccgatcacagtatccacatctatacaatgattgatccagctgtggccctcccctctcacccagccccatgtggcttcctttgaaactgcagactggagatgacagtggtgaattctagtcctactcactggatatcagcatttcttttttttaaaattttattattattaaactaagttttagggtacatgtgcacaatgtgcaggttagttacatatgtatacatgtgccatgctggtgtgctgcacccattaactcgtcatttagcattaggtatatctgctaatgctatccctcccgcctcccccaaccccacaacagtccccagagtgtgatgttccccttcctgtgtccatgtgttctcattgttcagttcccacctatgagtgagaacatgtggtgtttggtttttcgtccttgcgatagtactgagaatgatgatttccaatttcatccatatacctacaaaggacataaaatcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttataatccgttgggtatacacccagtagccataaaaaatgatgagttcatgtcctttgtagggacatgaacatacatgtgcatgtgtcttcatagcagcatgatttatagtcctttgggtatatacccagtaatgggatggctgggtcaaatggtatttctagttctagatccctgaggaatcgccacactgacttccacaatggttgaactagtttacagtcgcaccagcagtgtaaaagtgttcctgtttctccacatcctctccagcacctgttgtttcctgactttttaatggttgccattctaactggtgtgagatggtatctcattgtggttttgatttgcatttccctgatggccagtgatggtgagcattttttcatgtggtttttggctgcataaatgttttcttttgagaagtgtctgttcatgtccttcgcccactttttgatggggttgtttgcttttttcttgtaaatttgtttgagttcattgtagattctggatattagccctttgtcagatgagtaggttgcaaaaattttctcccattttgtaggttgcctgtccactctgatggtagtttcttttgctgtgcagaagctctttagtttaattagatcccatttgtcaattttggcttttgttgccattgcttttagtgttttagacatgaagtccttgcccatgcctatgtcctgaatggtaatgcctaggttttcttctagggtttttatggttttaggtctaatgtttaagtctttaatccatcttgaattaatttttgtataaagtgtaaggaagggatccagtttcagctttctacatatggctaaccagttttcccagcatcatttattaaatagggaatcctttccccattgcttgtttttctcaggtttgtcaaagatcagatagttgtagatctgtggcgttatttctgagggctctgttctgttccattgatctatatctctgttttggtaccagtaccatgctgttttggttactgtagccttgtagtatagtttgaagtcaggtagcatgatgcctccagctttgttcttttggcctaggattgacttggcgatgtgggctcttttttggttccatatgaactttacagtagttttttcctattctgtgaagaaagtcattggtagcttgatggggatggcattgaatctataaattaccttgggcagtatggacattttcacgatattgattcttcctacccatgagcatggaatgttcttccatttgtttgtatcctcttttatttcatcgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgactttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttgggtttctttatatgctgtattacatttattgatttgcgtatgttgaaccagccttgcatcccagggatgaagcccacttgatcatggtggataagctttttgatgtgctgctggatttggtttgccagtattttattgaggatttttacatcaatgttcatcaaggatattggtctaaaattctcttttttggttgtgtctctgcctggctttggtatcaggatgatgctagcctcataaaatgagttagggaggattccctctttttctattgattggaatagtttcagaaggaatggtaccagctcctccttgtacctctggtagaattctgctgtgaatccatctggtcctggactctttttggttggtaagctattgattattgccacaatttcagagcctgttattggtctattcagagattcaacttcttcctggtttagtcttgggagggtgtatgtgttgaggaatttatccatttcttctagattttctaatttatttgcgtagaggtgtttgtagtattctctgatggtagtttgtatttctgtgggatcagtggtgatatcccatttatcattttttattgggtctatttgattcttctctctttttttctttattagtcttgctagcggtctatcaattttgttgatcttttcaaaaaaccagctcctggattcattaattttttgaagggttttttgtgtctctatttccttcagttctgctctgattttagttatttcttgccttctgctagcttttgaatgtgttagctcttgcttttctagttcttttaattgtgatgttagggtgtcagttttggatctttcctgctttctcttgtgggcatttagtgctataaatttccctctacacactgctttgaatgcgtcccagagattctggtatgttgttctttgaaaccaatgagaacaaagacacatctttatttctgccttcattttgttatatacccagtagtcattcaggagcaggttgttcagtttccatgtagttgagcagttttgagtgagtttcttaatcctgagttctagtttgattacactgtggtctgagagacagacagtttgttataatttctgttcttttacatttgctgaggagagctttacttccaactatgtggtcaattttggaatagttgtggtgtggtgctgaaaaaaatgtatattctgttgatttggggtggagagttctgtagatgtctattaggtccacttggtgcagagctgagttcaattcctgggtatccttgttaactttctgtctcgttgatctgtctgatgctgacagtggggtgttaaagtcccccattattattgtgtgggtgtctaagtctctttgtaggtcactcaggacttgctttatcaatctgggtgctcctgtattaggtgcatatatatttaggatagttagctcttgttgaattgatccctttaccattatgtaatggccttctttgtctcttttgatctttgttggtttaaagtctgttttatcagagacaaggattgcaacccctgccttttttttgttttccatttgcttggtagatcttcctccatccttttattttgagcctatgtgtgtctctgcacgtgagatgggtttcctgaatacagcacactgatgggtcttgactctttatccaatttgccagtctatgtcttttaattggtgcatttagcccatttacatttaaagttaatattgttatgtgtgaattttgtcctgtcattttgatgttagctggttattttgctcgttagttgatgcagtttcttcctagccttgatggtctttacattttggcatgattttgcagtggctggtactggttgttcctttccatgtttagtgcttccttcaggaggtcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcttggataatatcctgcagagtgtttccaacttggttccattctccccgtcactttcaggtacaccaatcagacgtagatctggtcttttcacatagtcccatatttcttggaggctttgttcgtttctttttattcttttttctctgaacttccgttctcgcttcatttcattcatttcatcttccatcactgataccctttcttccagttgatcgcatcggctcctgaggcttctgcattcttcatgtagttctcgagccttggctttcagctccatcagctcctttaagcacttctctgtattggttattctagttatacatttgtctaaatttttttcaaagtttttaacttctttgccatttgtttgaatttcctcctgaagctcggagtagtttgatcgtctgaagccttctctcaactcgtcaaagtcattctccatccagctttgttccattgctggtgaggagctgcattcctttggaggaggagaggcgctctgctttttagagtttccagtttttctgctctgttttttccccatctttatggttttatctagttttggtctttgatgctggtgatgtacagatgggtttttggtgtggatgtcctttctgtttgttagtgttccttctaacagacaggaccctcagctgcaggtctgttggagtttgctagaggtccactccagaccctttttgcctgggtatcagcagcggtggctgcagaacagcggtggctgtagaacagcagatattggtgatctgcaaatgctgctgcctgattgttcctctggaagttttgtctcagaggagtactcagctgtgtgaggtgtcagtctgcccctactgggggggtgtctcccagttaggctgcttggaggtcaaggacccacttcaggaggcagtctgccggatctcagatctccagctgcatgctgggagaaccactactctgttcaaagctgtcagacagggacatttaagtctgcagaggttattgctgtctttttgtttgtgccctgcccctagaggtggagcctacagaggcaggcaggcctccttgagctgtggtgggctccacccagttcgagcttccaggctgctttgtttacctaatcaagcctgggcaatggcaggcgccctcccccagcctcgctgcctccttgcagtttgatctcagactgctgtgctagcaatcagcgagactctgtgggcgtaggaccctccgagccatgtgcaggatataatctcctggtgtgccgttttttaagtccattggaaaagcgcagtattagggtgggagtgacctgattttccaggtgccgtctgtcacccctttctttgactaggaaagggaactccttgaccccttgtgcttcccaagtgaggcaatgcctcaccctgctttggctcacacccagtgtgctgcacccactgccctgcgcccactgtctggcactccctagtgagatgaacccagtacctcagatggaaatgcagaaatcacccgtcttctgcattgctcatgctgggagctgtagaccggagctgttcctattcagccatcttggctccacccctcaaaacttttaaagtaaatattctatgactttgcagttgctacttcttggccatgagctctgtaaaaggatctttgtagtattggttataagtaaaaatctgtaattaattgtacattatttggattggttagagataaatcttcagttccaaggaatcctgttgtatgtagtcacaaaataggacaaaagagatgataaagatatgcgttgttcgagtttattgagcatgtatggtgtgctaggcacttctaagtgcttgacatatattcattcatctgatcctttcaaacactttatgatctatttattttaattctaaaaatttatttattttaagacagtgtctcacccctgtcacccaggctggagtgcagtggcgccatcttggctcactgcaacctccgcttcccaggttcaagtgattctcctgcctcagcctcctgagtagctgggattacagacgcacatcaccacgcctggctaatttttttgtatttttagtagagacggggtttcagcatcttagccaggctggtctcaaactcctggcctcaagtgatttgcccgcctcggcctcccaaagtgctggcattacaggtgtgagcccctgtgcctagcctgaaaatttatttttaaaaattgagacagggtctcactctgttgcccaggctgaagtgcagtggcacaatcatggctcactgcaccgtcaaactcctgggctgaagtgatccttctgtgtcaggctcatacaccttataatttagatacaatgataaagaagaggaaattcagttagtgagagattaaggaatttgcccaaggtcctataactagtaaaaggcaaaaccttgaaatttgaacctggccagactccagagccagtgctttaaattaagcagctgtgcatcctgtagtaggtggatgtgacatgtgccttgaaagcacaggaagagctatatacctgtccagggggttgctgaaggcctgtgaactttgcaaacgttaaaaacaatgatagggccaggctcagtggctcacacctataatcacagcactttgggaggccaaggcgggcagatcattggaggtcaggagtttgagaccagcctggccaacatggtgaaaccccgtctctactaaataaatacaaaaattagccgggcatggtagtagacgcctgtaatcccacctacttgggaggctaaggcaggagaatctcttgaacccgggaggcggaggttgcagtgagcagagattgcgccactgctccagcacgggtgacagagtgagactccatctcaaaaaagaaaaaaacaaaaaacagtgataaactacaggctttatggggatgagcgtaggagatagtgagacagggaaaactgtaacagctgaaaattgactgagatctcttggaatctataacaacttttttgtggtgctcttttccttcttgatgccacccttcttctagtgaaggttggttgtaagattgaggttacatgtgtttgatattgtaggaggctgtgacattcaaggatgtggctgtggtcttctccagggaggaactgcgactgctcgatcttacccagaggaagctgtaccgagatgtcatggtggagaacttcaagaacctggttgcagtgggtgaggacaggcactctctgaccctgaacttcagttcccttgagaatctctttgctctcaggtgtttaagggtttggaccttttaaaatggttctttgctcttgaagacaaaaggttttctaatccctgggaaaacaggataggtttttctggtctttctgctcaggcaaaattctgtccttttaaattgctggttctcaaccatgggtgatttcgcccccagaagatatttggcaatgtctggaaatggttgtcacacctgacagaggggtgctattggcattttgtgggtagtatccaggaattctgcaaaatctcctacagtgcacaggacagtgcccccaacagagaattggccagtccaaaatagtagtgctgcagttgcaaaaccctgttttaaatgaaccgtaaatggacacattagcttctatgctttatctttcaaatacgttgtctttcaaatgaaacccatcaatgcattaacttagtgcactgtactggcttttttttcaatgaaataaaacagataaggatagaaaatatcagagcttcttatcaggaactgctcacattgcaacaaaaactgacaattttcagtgaatggtgtgagatacagcattgcaaatgtgatgaaaacagacattagccaagtataacttgagagagagatatattatatatatatgaactaggctacaacctaaatttcttattatagttcatgatcttaaaacatcttaaaataaatcactctagaggccgggcatggtggcttacgcctttaattgcagcaatacgggaggccagggtgggtggatcacttgaggtcacgagttcaagaccatcctggccaacatggtgaaaccccatctctactaaaaatgcaaaaattagccgggtgtggtggcaggtgcctgtaatcccaactactcgggaggctgaggcaggagacttgcttgaaccctggaggcagaggttgcagtgagccgagattgtgccattgcacttcagcctgggcgatagagtgagactctgtctcaaaataaataaataaaataataaaatatcactatagaggttgtgaggcttatagggttcagacaaaaatgtgttttagttgtgtgttcatcttaaatacataaaaatctacattttcatagggcatcttcccttccaaccagatatggtatcccaattggaagcagaagaaaagctttggatgatggaaacagaaacccaaagaagtaggtattctggtgagaaccctgtgtctgttctttcaggtactggttagtctgcatcttaccatgtccatgacctccctggtctgagtgttaaaatctttcacctggattataacaatagcttccatgctggtctccccacctcctcccttgtgctcctataatctgctttctaaatggtagccggagtggttctttttttaatctttatttttttgagacagggtctcaccctgtcacccaggctggagtgcagcagcatgattgtagctcactgcagcctcaacctcctgatttcaagtggtcctcccacctcagcctcctaagtagctaggactataggtatatatcatgatacctggctaattttttattttttgtagagatgaggtcttgctgtgttgcccaggctggtctcaaactcctggactcaagcagtcttcccacctcggcctcccaaagtgctgggattacagatgtgagttgccgcacccggcccagaatggttctttaaagaacacatgagatgatgttattcctctgctcagaagccttcacaaccttcccatttcactcaaagtccttgtactgaactgcaagaccctacctggtctcatctcaccaagtttctctttgatctcccattcctttccctttgcttagatcatttcagccatgctggccgccgttggagtatttgttaagcataccaagttcccttctcttccatggcttctaattagctctcctcattgccttggtggagaggctccccagcaccttacttactgcactcaggtcattcctcaaatgttatatcattagagaggccttctatgtttaaatttaccattttaatttaaaataccatcttccttccattttccatccccttacctttcctttctctccttctttgctttctcttgaatttgcatattcctcaggtctattgacttaaaaattaaaagtaagctgggtatggtggtacatacctgtaatcctggctacatgggaggctgaagtgagaggatcacttgagctgaagagttccagaccaacctgggcaacatagtgagactccatctctacaaaaaaaaaaaaaaaaaaatatatatatatatatatatatatatatcttagccaggcatgttagcatacatctgtagtcccagctacttgggaggagcatcaagtgagcccaggaatttgagaccaacctggacaacatagtgagaccttgtctcccacacacacaaaattaaaagtaaaaattagatattcctagatgatgtgaattttttttttttttgagaccgagtcttgcttgctctgtcacctaggctggaaagcagtggtgccatcttggctcactgcaacctctgcctcccgggttcaagtgattgtcctgcctcagcctccgaagttactgggattacaggtgaccaccaccatgcccaactaatttttgtatttttaatagagatggggtttcaccatgttggccaggctggtattgaagttctgatcttacccactttggcctcccaaaagtgtcacccaggctggagtgcagtggcatgatcttggctcactgcaaccttcgcctcctgggttcaagcaattctgctttagcctcccgagtagctgggattacaggcgcctgccaccacacccggctaatttttgtatttttagtagagatggggtttcaccatgttggccaggctggtctcgaactcctgagatcgtggtccacctgtctcagcctcccaaaatgctgggattacaggcatgaaccaccatgctcagccaaagggtttgtttttataagaattcttaacaaaaaacttacagagaatggagacaagtagatatcacatcccttttactcagagttagctcatagattgagagcacaccagtgtgattaattatttgggaacactgtcttctagtgaatgtctaacataattagtaatttctaagacatttttggacatgtaaatattcaaacctactaaccttagaagataaaagctattcacagttgttggaatgtagaacttcactatcaaaaattatcagtggcaatatggcaggtattatagttcatcagtttccctgtatcaatttcaagttggctttactcattggtgaaaactgccttatccatacagctgacttcccactttcccatttccccttccctctaataccaaaacagttatataacctacatacagtagttctttagcagttttgaattggacatttccagaagtccagaggcactgacatacctgtggagttgaggtgagtcctgattaggcaaagaaaattccagaatttctaaattgggtttccagtgtaatttgcatccacatgtattaatcttagcttctagcaccagcaatgtgagaagcactttacatgttgcagtgacttctgacaccaaacacctgaagttaggccggactttcagagtaagggcatagttttccacaagactgctctctatatcgctctaagtttatatatcgctctaagtttagggattcccagataattttgctcacctctgaccaagtagctacaaatttgggagttcccgtgataatttgttagaatgactgacagaactcgggaaggtgctggacttacagttttattatagcaaaaaagatacatgttggaagcagcaaaagggagagatatatagggtgaaatctgggtggcttccctctttcttcccttttgtaaggacttgtgattactttaggctcattggataatctaggataatctccttaagagctttcatttaatcatatctataaattgcttgtttttttgttttttttttttgtagacggagtcatgctccgtcgtccaggctaaagtgcagtggtgcaatcttggctcactgcaacctctgccttctgggatcaagcgattctcatatctcagcttccctagtagcttacaggtgcctgccaccatgccaggctaattgtttttttagttttttagcggagacggggtttcaccatgttgtgggccaggctggtctcgaactcctgacctcaagtgatccacctgcctcggcctcacaaagtgctgggattacaggtgtgagccactgtgcctggcctgtaaattcctttttgccatgtacattaactattcacaggtttgagagttcaggctgtggacatctcttgggggtggggtgtcattactcagcctgccatatccagaaatgtgtagacacctgttgctatttttttttcagtttgtattattagaatgtaacatttcatttaggcaaattatttgattaggacttggtaaaccaccccctaaacattttaagccaaggtctttcatacgtttctaaccatgaccctcaacataagtataattttacatcttgactaagcataaatatgtttatatttatgtgtatatttaccaactaaaacaagtatttcctatagtagtactcttattgcttttaatacactaagcatgtcttattctgttttttgtttttttgtcagtcacaagttacatacttggtttcatggtgcactaatgcattgcaacaatttgaaaacccttgttaacagtggggataaagcaatgaagaaaacaaaatgcgtgtttttttcatgaccgttacattctactgggtctaaagagacaaaggaaagtatatagtaaatcaaataataagtactgtggggaaaagtcaagcagggtaattgaactggaaagagtcgaaggtgtatggcaggccgggcgtggtggttcagcctgtaatcccagcactctgggaggccgaggtgggcagattacttgaggtcgggagttcgagaccagcctggccaacatggcaaaaccccatctctactaaaaatacaaaaattggctgagtgtagtggcatgcgccagtaatccccgctacccgggaggctgaggaggagaatctcttgaacccaggaggtggaggttgcagtgagctgaaatcacaccactgcactccagcctgggcgacagagcgagacgctgttttttaaaaaaaaaatggcgtatggtggtaccgttgatttatttttacatcgtgtgttatggaaggcatcacagataaagtaacatgtaacatgtgagcagagacctgaagggagcgagagaacaagcaaggctccctgctttctgggaggaagtttccaagctgaacatacctctccctctcttcgtcttctgtgttggctttgagagtttgcactatgctctatttcctctccgaagttctctcctagttatacaagattagctttcccttttccacttgtccagagacctggatttctaccaggttttagaacaatcatattattccaactgccttcccaaatctgttggagaataatttctatcaggatctaaaatagtatttcatgcctacagtctgaacttttcttaacctaactagttattagaatcccgcttgtcataagcctactgaggaagaggtgagtaggctgttcattgatgttattgtaggttggaatatggattttctttttgttgccctgcagctacctgattttagcttttagctctcatattaaactgttagacttacggttctacatggatcatgtttatacttagtgaatgggagcctgttgaccccactcttcgtttacacctgtatgaaaaacatgtcaaaagaatacacgatgctgtaaggacaaggtcacctttcgcctggtttatcaaggctttctcccatggcctaagtgtgaaattctgatatttctgaagaaagcatttactgccctcatctctaaatattgccttttttcttttttaataggcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaatcagaaattacccttaggagagaaaccccatccatgtggtgagtgtggaaggggcttcagttatagcccaaggcttccccttcatccgaatgttcatacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgtagctaaggactcatgattcttttatatggtatataggtgtaaaattaaggaatatatccccagagatgaatctttgatcttcagaagtaaatttatatctgctgtagaggtgtattaaaggatagtagtatggccgggcacggtggctcacgcctgtaatcccagcactttgggaggccaaggtgggcggatcacaaggtcagaagattgagaacatcctggctaatatggtgaaaccccatctctactaaaaatacaaaaaattggccaggcatggtggcacgtgcctgtagtcctagctactcgggaggcggaggcaggagaatcgcttgaacccaggaggtggagttcgcagtgagccaagattgcgccactgcactccagcctggtgacagagcgagactccatctcaaataaataaagaagaaagagagagagagagcaagagaaagagaaaagaggatagtcggtgcatcattgttttagtagcaaacatagaaatacttggattgccaaagtattttgtgctttaccaatccagtggcacactatgcagacatcaaatgggaaaaggtaaatttttagctgtggatattggaagatgttcagaatatattaacttgaaaaacaaaatgtgagatttttatgtgatcctattttgtaaaaacgcatagatgaatgggtattatagttctctctaaataatgggattttactttatgtatatttttatatttctttaaacttattttgaaataatttgaaactttcagaaaaattacagaaattatataaaagctcccatatactctttacccagattcaccagttgttaagatgtttgaattattctctcaataagtatgagcgtgtatatactgatacttatacatactaaacgcatttatatataaagttttgccatatgaatatgttacagacatccttctccctacactaaatacttaagtgtgctttcctaagaacaaggatatctacttagttacagtacaacattccagtgatttatttatttagagacagggtctcattctgttgcccaggctgagtgcagggtggtgattatagctcaccgcagccttgaactcctgggctcaagcaatcctccccactcagcctttcaagtagctgggactgcaggcgtggaccaccatgcccacctaatttttaagatttttgtagagatgggctctcgctatgttgtctaagctggtatcgaactcttgggcttaagtgatcgttccacctcagccttccaaaatgcaaggtttacaggcatgagccactgcacccagaaagaaaatttattattgatacataacactatgtaacctacagaccttatttaaatcttaaaattatcccaataatatatttattgtttttctgctctagagtccaaagattacacattgcatttagactcctttaatctgagttgctacctctgtttttaatgaccttgatatttttgagattattttgtagaatgtctcttaatttggatttgcctgaggtttccttacaattggatttaaattacacatttttttcccatgaggactctgtaagtggtgtgcagcacgtgaggaaacgaggtatgtttgtacctttataggtgatgttaacttggaacacttgattggggagggcggtgctgggtttttccactgcgaaattactatttttttctttgtaattaataattacaaaggcaactcctggggagacactttctgactctaaatagcttgtttttcagtaaattttcctccactagtttaagcattctgtaagtctggtctaaatcagtaattgctctgatggtgcgaaagtgtgatatattcaactttcatcattcctccaacacttgttagattgttgttctactctaaggaagtttcccttctgtcctgtttgcccatcatgtatttttaaataaattggagcacatctttactctgacacaatacagtgttccaagctcatcttgtacccttcctgcaccatccatggaatttgctgtttctttgagaactcagattcttctgattgggggatggtagttaaacatcaagatctgggtaatagctgtgcctttttttttttccctctaggaaggaggggaaagagttatacagataggaagagaagtagaaaggtagaaagaattaatgatgagttcctgcttttatctctagttcttaaattaatatcatagtgttttttttctagccttacccccattctatgttgcatcttcattcttcaagaatcagaaatttgtctcccagtatcattcatatatttactggggaatgtggacatgcatccaactagaacttgggggttctgtctttcagagagaacgggagtattggatgactgatgccagagatgatttttgaatggcatagtctcccaaacattataatttttcctattctcagggtattgaccctttaaaccaaataaaatgttcccgtagggccatgaagaaaagtatctgatagaaatatccaaagatagatatattcagatgagagccttccagtcaatgtttccttgcagatagtgttaaggaatggtttctggtgaagtgttgcggagctctcctagcctgtgagtgtcacggatgccattgattagcattgctttactttatttacctctcattctctgaaccttctcagaggtagtttgacaaagttctcaaagcacatccctctactgcttcttgagaggaccaaggcattttaggagaaactagtgttaacgagaccaagtcagaatattggtaataaagtagtagagtataatagaaagcagactgtcagccaggcacagtggctcacacctatagtctcaactactcaggaggctgaggtgggaggatcacttgagcccaggagtttgaagctgcagtgagctgtgattggaccactgcattccagcctgggtgacagtgagaccccatcttgaaaaagccaactgggtgcagtggctcccgcctttaatcccagcactttggctggccgaagtgggtggatcacctgaggttaggagttccagaccagtctagtcaacatggtgaagccctgtctctactaaaaatacaaaaagttagccaggcgtggtggttagcccctgtaatcctagctattcggctgaggcaggagaatcaattgaacccagcaggtggatgttgtagtgagctcagatcgtgccattgcactccagcctgggcaacgagtgaaactccatctcaaaaaaaaaaaaaaaaaaagaaaagaagaaaagaaaaagccaaccctggaaccctggaattagactttcttgctcagtgtaaccatttgctagttgcgtaactgcaggcaaaatgcttaacctctctattcctcaatttgcttgtgtcttcaatgtttgaggataatatcttttagttctgtggtaagggttaaaactatatgcctggcatatagtaagacctgtatagtgttaactattattttcaacatagatgtcactattactagatttctgctaatttatatttgaaatttctaaggaagggatcagtaaactatagcctgctggccaaatctagcctgtgtcctctctttgtacaacacgagagctgagattttaaatgtttaaagagttgtaagaaaaaaaaaatgctacagagaccatctgtggcccgcaagacttaaaacattactgtctggccctttttaggaagtttgccgttctctgatctaagcaaattttagtttctcagaagccttgcttctgagatacatacatactacagatatgtattatctcaattcagtacttctcaaatcttttaggtttaaaaaaaatgctcgaattgacataagaaaacacaagcatattttttacagaaaattgggaccatatatgaagcaatgtgctgtgtgtccaatgtgtagttaatctgcaattctatgaataaatgttattggtttttttttttttttttggtaagtaaacttaggttttacaggtttaagtaccttccctaagtcagtcagtagtgaatgtcacaaccacagtttgaactcaggtctatcttgctgacttcaaaactactcttaaatgctatgtgcataaattacattgcaaggccagaactcctaagtttacattctgtagagcatgcatcccatttcacacaagtaaagtgcaaatataagaatggaatatccttcaaaaagaacgaaatttgcctaggaagtcttttgctccatttcgactcaggcttttcctatactaagtcaataatctaggcaagcttgtccaacttgcagcccaggacagctttgaaagtggcccaacacaaattcataaactttctaaaacatgagattgtttttgcaaatttttaaagctcatcagctattttatgggtgacccaagacaattattcttctagtgtggcccagggaagctaaaagattggacacctcgatctaggagatatgttttgtatttcctatgtccttgattacatttctgacctcgttgatgccattaatttttaaatatttcttcttgtttgatgattaaaaatccaatactgaaaaattaactcaaatgttgaaaaagaacagccatgtttgaagctttaacctagcagttgtaacctaactgaatgtacctcttccaactgtaattttgcagtccacttgaggaaggaatcctttttaggacttacctgaaactatttacttggcagttcctccacaaaatcaggtttatttaaaaatatgcagctttttccaggcatggtggctcatgcctgtaatctcagcactttcagaggctgaggcaggagaatggcttgaaccccggagttcaagaccagcatgggcaacatagtgagaccccatctctacaaaaaaatcaaaaaattagccgggcattgtgtcacgtgcctatagtcccagctacaggctcagtggctgaagtgggaggattgctagagcccaggaggttgaggctgcagttgtgatgttgcactgctctccagcctggggccctgactcagaaataataatcttaaaaatgcaggttttaggatagccattcacttgaaaattctaagttggagagccttttgacaatgtatacccatatttctcttctctttttccctcccccttttaagttgtgaggtataattaacatacaataagctgtacatatttaaagtgttcgatttttaaagttttaatatgtgtatctttgaaaccatcaccacaatcaagatagcaaaaatatccatcattcttcaaagtcacctcatatctcccttttaatctccattctgctcctccccaatccccaagcaaccactgatctgctttctgacactgtatagtttgcattttctacaattctaacaaatggaaactgtacagtatatactttttttcctaacttcttgcagaaagagattcatccttgttgtttgtatagaattaattctttattactgagcattactgtaagtgtgtagatataccataattttttaaaaaaaatccatctgttgatggggatttgagttctcaaacttttggctattataaatgctatgacatgctatgaacacttgtttgtgtacaagtgtttgcatggagatatgtatagtctagaaatatatatatatataccatatataactcgactatatattttatcttggataaatagctaggaattgaataactggatcatatggtaaatatatgtataacttttattgtatttttaatttggtatttttatttatcagagttatagaaatttggaggagtacatgtggtatttcaatacatgtgtacaatgtgtaatgatcaaatcggtgtagttgggatgcccatcaccccaaacattgtgtttaacttttttttgtgtgttttgagacggagtcttgctctgttgcccaggctggagtgcagtggcatgatcttggctcactgcaacatcggcctgcggggttcaagcaattctcctgcctcagcctcctgagtagctgggactacaggcatgtggcaccatgccttgctaattttttatatttttagtagagatggggtttcaccgtgctggccaggttggtcacgaactccagatcttgtgatccacctgcctcagcctcccaaagtgctgggattacaggcgtgagccactgtgcctgcccgtgtttaactttttaaggaatttccactcttttccaaagtgggtgtgctgttttacgttttcaccagcagtgtgcatcttttcttcacattttcatcaaaatatgtaacggtcggtctcttttaattttagccattctaccctagtagtatctcactgtgtttttaatttgcatttttctaaacatgtttttcatgtgctgttttccattatcatatctttggtaaagtctacttaaatactttgcccatttttttattgggttacttgttttcttattgagttttgtgggttctttgtatattattgatacaagtgctttatcaggcatgtgatttccaaaattttttcactcagtctgtggttaagcagaagtttaaaatttttatgaagtctagtttatcataattttctttgatgtatcatgcttttggtgtcatatctaagaaacctttgcctaatccaaggtctcaaagactttctcctatgttttctgctaactttataagtttaggtgtttttttttttttttttttttgagacggagtctcgctctgtcgcccaggctgtagtgcagtggcacgatctcggctcacggcaagctccgcctcccgcgttcacgccattctcctgcctcagcctcccgagtagctgggactacaggtgcccaccaccacgcccacctaattttttgtatttttagtagagacggggtttcaccattttagccaggatggtctggatctcctgacctcgtgatccacccacctcggcctcccaaagtgctgggattacaggcgtgagccaccatgcctggccaagtttaggttttacatacagatgtatgatccatttttagataatacttatatataatacaaaacacgtttattcatcttaaaactatggatgtccagttatgccaacaccatttgttgaaaaaatgatcttttctccattgaattgactttgtgtctttgtcaaaaatcaattgaccgtatatgagtgggcctatttctgaactctccattctagctcgttgatctttttgtctcttcaccatacacagccagttgttcttgattactaacatagctttatagtaattctctctaaatcaggtagcacgagtcttccaactttgctttttcaaaattgttttagctattctagttcttttgctttttcatgtaagttgtagaatcatcttgttgattcttttaaagaatatttgcagggcttttaatgggaagtgtgttggaagatttgacttctttagtcttccaatcagtgaaaatggcatgtctcttcacttatttaggtcttttatttcatcagtgatttgtatttttcagtacacagatattgcctgttttcttagacttgtacttaaaaaattcctgaaaattttgttctgttgtaagtttctatttgttcataatagtatatagaaatgcaacttatttatattaacattgtatattaacattgcatcccaggaccttttgaaactgatttattagttctggtaactttttcattctttatacataatcatgttgtatgcaaatggagacagttatttcttgttttccaatatgttttctgtttctttgcttgtttccctaagagctttttctgcatctactaagatgattgaagagtttttgttctttagtctattaatatagtgacttaacattcattttaaaatgttcgaacaacattgcattcctgagataaacctacttaatcatgatgtagtattattttcatatattcgacttgctggtatttgttgaagaattttgtgtctatgtttatgaggaatattgatctgttgtcttcatgcatttttctaattttggtaacaagataatgctagccttataaaatgagttgggaagtgtttttctcctctttattttcttctttttcctcaaaatgtttgtgtagaattggtagtttcttttcccttaaatgtttggtacatataagaggcttaggcctggtggtggtgtttctggaggtgttttaacttgaattcaatctcattaataggtataggaatattcaggatgtctgtttattcttgaataaattttggtagtttttcttttttaaatacattgtctatttcatctaggttgtcacatatggcataaagttgttcataatatttccttattatcattttaatgtcattaggatctggcgtgtgtgtgtgtgtgtgtgtgtgtgtgtgtgtgtgtgtctcccaggctggagtgcagtggcacaatcttgcattcacagcaccctttgcctccggggcaggtttaagtgattctcctgcctcagcctcctgggtagctggtatttttagtagagagggggttttgccatgttggccaggctggtctcaaactcctgacccctgaagtgatccacctgcctcagcctcccaaagtgcagggattacaggcgtgagccactgcacctggcctgtcattaggatctgtaatcatatccttctttcagtcctacaattggtaatttctgttttgttttcttgttcttttcaaagtttattgctttttcttcactattgttatccttttcgtttggttgatttctgctttcatttttgttgttttcttctttcttgcttaggggtttttcttttttcatagacagggtctcactctgttacccaggctagtctcaaactcctgggctcaagcagttctcctgccttggcctcccccaaatcctgggattacaggtgtgaaccattgcacccagcttttttttttaaagtttattaagcttaaaaaagcttagataattgatgtaagttccttttcttccaatataagcatttcatgctctaaatttttctctaaatgctgccttagtggcattctacaagttctgatatgttatctttttatttttatttcttattttcccttttctcttctaactcatggggttttttttgacccatgggttatttaatttctaagggtagtgggggattttcctgagattgttttgttattgattctcatttaattttgttgtgatatgagaatatactttgtgtggtttcaattcttttaaattggtgcagtgaattacatggcccagagtatgatccatcttggtgtatgttttaatgatgttgattaataatgttgttgaggtcttctatatccttactggttttcttttcttttttccatcacggcaagagttcatcatgacttactggttttctatttgttttattgattaatgagaatgaagtctccagctgttaattgtgggttgtttagtctttgtctttatcagttttggctttgtatattttgaagctctgttgttttgtgcatacacatttaattttatgtctttttggtgaaattacctctttattattatttaatgtccctcttatttctggtaataatccttgttttgatgcctactttgtttgcttttaatatcaccactatagcctttttttttttttttttttttttttttttttttttttttgagagggagtcttgctctgtcgcccaggctggagtgcaatggcacgatctcggttcactgcaagctctgcctcccaggttcatgccattctcctgcctcagcctcccaagtagctgggactacaggcgcccgccaccatgcccagctaatttttttctatttttagtagagatggggtttcaccatgttagctaggatggtctcaatctcttaacctcgtgatccgcctgccttggcctcccaaagtgctgggattacaggcttgagccaccgcgcccggcccactgtagccttttattagtgtttgcctaatagtagtatagccactccagctttaatttgattattgttgctttattctccaatctgatgatttgttataattggtatgtttatgtcatttatatatcatttagtaattgatatggtcagatataaatctatttttggttaccttctttgtttcttttccttttgttacacattttttgctaatttttaaatatgatttcatatcgtatccacaattagcttatttttacaggctgaatatcccttacccaaaatgtttgggattaggagtgttcagatttcggattttttcagattgtggaatatttgtattgtagttatcagttgagtatttgcagtctgaacatctgaaatccaaaacactcccatcagcatttcctttgagttgtcatgtaagcactcaaaaaaattcagattttacagcatttggatgttcaggttggggtactcaacctgtacctcttttcattattgttttagcgtttactgtagaatttacaatattcatctatagttaatgacagcctctctttaaataatatatactattttatttattttatttcactaggtttttgggaaacaggtggtgtttggttaatgagattttgaatatatactctttacttatacaactgtacactcccaattccttccttcaaacttttgtccaattgtcaagcatttgtcgttggcatatgctataaagccacagtacattgctattatttttgctttaggagtcaagtgtctttcagagcaattaaaagttaaattcttaactgcttctggaaatcgtcattactttgcaagtttaccaaattttatatagcatcctttctgtttgaagaactttctttaatgtttcttgtactgctggttggctgctactgaattttttcagtttttgtcttaaaaagttttcattatatcttcattttcgagggatgtatttgctgggtatggaattatgtgttgttgtttttttctttctatactctttgtattctggtttgcatagtttctaatgagacatgtcctgtaattctcatctttgattctttgtatgtattgtgtctcctcacccatcccctgcctttggccgccttcaaaattttctctttattttgaatttactgcagtttcaatatgatgtgtctaggtgtgattgtttttatttttattttaaaaatacagatactaccattgaaaatccacagaaatatattcattcacctagaaactcttgtttcttactacattcttcatgtaataaaccaaaggatggaagggtgtatattttagtacattagaaaaagctcatttgcatatacttcttgaatttttcatgtgcacaaagacccactgaaagtatacacgaaaaactaacactggtcgggcgtgatgacttatgcttgtaatcccaacactttgagaggacgaggcagacagatcacttgaggtcaggagttcgagaccagcctgggcaacatggtgaaactccatctctactaaaaatacaaaaatcagccaggcgtggcggtacacatatgtaatcccagctacttgggaggctgaggcaggagaatcgcttgaacccaagaggcagaggttgcaatgagccaggattgtgccattgcactccagcgtgggtgacagagcaagactccatctcaaaaaaaaacaaaccaacaaaaaaaaaacacaaagattacatgtggtacatgggcttttggtataggcaaacaaccttgggtcagaatgggatgagttttcaaggtatattgtttatattattttaattttgtaccatgtaaatatattacctagtatagaaaaaaatttaaagcaaatttccccaaatgcattaatgggccttattttttcctttgcctagtttaattatttgattagagtctcagtattctctcatttataatacatatagacagttacacatccatatcttcatatttacacaattttagaaagtattacatttccctacagcctcactccatgggaagagtattgttaactggccattgtgttttaactcaccactggaaaagaaaaattaaacacacgtttaacaacgcagttttaaaacctaacaaagacccagtccacagaccccatatatgttactggctgctgctcaggatggtattttcatccctgagagattggaatgcttttttattttttgttgtcaatgggttttctcttgcctcattccaatcttactatttttctgcaaagcttgtttccctagtcctgctttcatccagaataaaagttcttaaaagcctatttctatcattaactaactccaggcttcacaatgagaacagtgaaaatatagtttctttttcctgaatcccataattagaactaccttgcagttcatattgtggacttctgttcattttcttctctccagctccagcattagctcatttatccaatcctatgttatccccagttgtctccacctcccctccaccccctagagttacagagacctcatattaccaggtgtttgaactacaggagttattgctacattttgctccccattccagtccaattgtacctgacaatattccaatttcaaatccattaagtataaactgttttaagaatggcaaagtataggctcaaaataaagagatggagaaatatttaccaagcaaatggaaagaaaaataaagcaggggtttcaatcctagtctctgataaaacagactttaacaatgataaaaaaaatacaaagaagggcattacataatggtaaagagatcaatgcaacaagaagagctaactatcctaaatatatatgcacccaatacaggagcacctagattcataaggtaagttcttagagacctacaaggagacttaagactcccacacaataacagtgggatactttatcacccaactgccaatattagacagatcaacaagacagaaaattaacaaggatattcaggacttaaactcagctctggaccaagtggacctaatagacatctacagaactctccatcccaaatcaacagaatatacattcttctcagtgacacatagcatgtattctagaattgaccacataattggaagtaaaacactcctcagcaaatgcaaaagaacagaaatcataacagtctctcaggccacagtgcaatcaaattagaactcaggattaagaaactcactgaaaactgcacaactacatggaaaccgaacaacctgctcctgaatgactactgggtaaataatgaaatttgggcagaaataaataagttattttaaatcattgagaacaaagacacaacgtaccagaatctgtgggtcacagcgaaagcagtgtttagagggaaatttatagcactaaatgccaacaggagatagcaggaaagatctaaaatcgacactctaacatcacaattaaaagaagtagagaagcaagagcaaacaaattcaaaagctagcagaagacaagaaataactaacatcagagcacacctgaaggagatagagacacaaaaaacccttcaaaaaaatcagtgaatgcaggagctggctttttggaaagactaacaaaacagagagaccactagtcagactaataaagaagagaaaagagaagaatcaaatagacacaataaaaaatgataaaggggatatcaccactgatcccacagaaatacagactaccatcagagagtactataaacacctctatgcaaataaactagaaaatttagaagaaatggatacattcctggacacatacaccatcccaagactaaaccaggaataagttgtatccctgaatagaccaataagaaattctgaaattgaggcagtaattaatagcctaccaaccaaaaaaaaagcccaggaccagatggattcacagccaaattctaccaaaggtacaaagaggagctggtaccattccttctgaaactattccaaacaatagaaaaagagggactcctccataactcatttcatgatgctagcatcatcctgataagaaaacctggcagagacaaaacaaaaaaagaaaatttcaggccaatatctttgatgaacatcaatgtgaaaaatcctcaataaaatactggcaaaccgaatccagcagcacatcaaaaaacttaaccaccatgatcaagttggcttcatccctgggatgtaaggctggttcaacatatgcaaatcaataaacataatccattacataaacagaaccgatgacaaaaaccacatgattacctcaataaatgcagaaaaaggccttcaataaaattcaataccccttcttgctaaaaactctcaataagctaggtactgatggaatgtatctcaaaataataagagctatttatgaccaacccatagccaatatcatactgaatgggcaaaagctggaagcattccctttgaacactggcataagacaaggaagacctctcttaccactcctattcaacatagtattagaagttctagccagggcaatcaggcaagagaaagaaataaagtgtattcaaataggaagagaggaagtcaaattgtttctgtttgcagatgacatgactgtgtatttagaaaagcccatcatctcagcctgaaatctccttaagctgataagcaacttcagcaaagtctcaggatacaaaatcagtgtgcaaaaatcacaagcattcctatagaccaataatagacaaacagccaaatcatgagtgaactcccattcacaattactacaaagagaataaagtacctaggaataaaacttacaagggatgtgaaggacctcttcaaggagaactacaaaccactgctcaaggaaataagagaggacacaaacaaatggaaaaacattccatgcccatggataggaagaatcgatatcgtgaaaatggccaccatacctcccaaagtaatgtatagattcaaggctattcccatcaaactgccattgactttcttcacagaattagaaaaaactactttaaatttcatatggaaccaaaaaagagccctatagtcaagacaatcctaagcaaaaagaacaaagctggaggcatcacgctacccgacttcaaactatactacaaggctacagtagccaaaacagcatggtactcataccaaaacagatatacagacaaattgaacagaagagaagcttcagaaataacaccacacatctaaaaccatctgatctttgacaaacctgacaaaaacaagcaatagggaagggattccctatttaataaatggtgttgggaaaactggctagccatatgcagaaaactgaaactggacctcttccttataccttatacaaaaattaactcaagatggattaaagacttaaacataagacctaaaaccatacaaaccttagaagaaaacctaggcaataccattcaggacataggcatgggcaaagacttcatgactaaaacacgaaaagcaatgacaacaaaagcaaaaactgatgaatgggatctaattaaagtgcttctgcacagcaaaagaaactatcatcagagtcaacaggcaacctacagaatgggagaaaaattttggaatctatccatctgacaaagggctaatatccagattctacaaggaacttaaacaaatttactaggaaaaaaaaaaaaactaaccccatcaaaaagtgggcaaaggatatgagcagacacttctcaaaggaagacatttatgcagccaacaaacatatgagaaaaagctcatcgtcactggtcattagagaaatgcaaatcaaaaccacaataagataccatctcatgccagttagaatggtgatcattaaaaagtcaggaaacaacagatactggagagaatgtggagaaataggaatgcttttacactgttggtgggagtgtaaattagttccaccattgtggaagaccgtgtggcaattcctcaaggatctagaaccagaaataccatttgacccagcaatcccattactgggtatatacccaaaggattataaatcatcctactgtaaagagacatgcatacgtatgtttattgcagcactattcacaatagagaagacttggaagcaacccaaatgcccatcaatgatagactgaataaagaacatatggcacatatacaccatggaatactatgcagccataaaaaggattaattcatgtcctttgcagggacatggatgaagctggaaaccatcattcttagcaaactaactctggaacagaaaaccaaacaccacatgttcacactcataagtgggagttgaagaatgagaacacatggacacggggaggggaacatcacacactggggccttttgagggttgaggtgctaggggagggatagcattagaagaaatacctaatgtagatgacgggttgatgggtgcagcacaccaccatggcatgtgtatacctacgtaacctgcacattctgcacatgtatcccagaacttacagtattaaaaaaaaaaaaaaagagtggcaaagtaatgtcagagaaatgatggagtaggtagcttcaacggcccatccttccacagaaacaaaacaacaaaaatgatttttaaaaaactgtcagaatcaatgtcatcagaactctgaaaagtagtccaaggtttacagcaacccagggaatgtagaatagagaaaacagcaacttaaaaatagtaggggagctttgtggtgctttcacttgcccttgatttacttttctctgcagctgggtgatggtcttgaaggtgacagcctatattaccagtgtaggacactgatctcttgctccagaggcagtggagcagaacttgttctcaattgtgtttgtctgttttgaactgtctgagggctacctgaaagactgttgcaagttacttggttttatcttatctaacttggaattctatcatggtggaaaagtggctaattgaagagtacattcctctaaatcattgaaaggcaaatgaacaacccactgtcacttgaggtaagagattactgttgaagcaaacaatatacagaatgacaacttgggaggaaaatctggggagagagattctgtgaggaagtagggtattgaaaagctccccacatacaccaggaaatttagaaaggcatgcacatactcagaggagaacatatgttcagaaatgacctgaaaaaactgcaagctttcacctctgactgatctttgacttagtgcaagcagtaagggaaggctttggcagagttgtaaatgacctggctaagcaccgaaagagggctccaacaaagagtcattgcgcaaagagtgggcaaatatttttccttttttgtttgtttttcatccagacattcaaggaaatccctgttaacacactgggtaaaaataaatgaaaagaatagaggccttagataccacacaatacagggaataccagttttacaaaaaaagtagtttagaaaactcactattcatttcccagagctgctcttaccacatggcacaaaattgggtggcttgaacaacaaaaattcattctctcccagttttctccaggttagacctccaaaatcaaagtgtcagaagggccatgctctctttcattaccacttagtagcttctgctggtatccattgatctttgatattccttggcttttagctgtatcacttcaagctctgtctctgtggtcacatggcattctccccatgtgtttcagtcttaatatggtatgttactcttctaataaggacactgtcgtatcgaatgagggtacaccctaatgccctcatcttgattgcatcttcaaaaaccctatttcaaagtaaggtcatgttcacaggttaggacttcaacatatctttttgggagacaaaattaaacctgtaacagtcactaaacaaaccattacgatccacaataagataagaacaaactgagcaggaggaagaatctgactttaagagataccacattataaaacaaacaaaaaaaaagtacacagcatgcaaataaaaaattatggtccattcccagaataaatgaacagaaactgtccccaaggaaacacagacactggacttaccagacaaagactttaaataaactgtcttaaatattctcaaagaactagaggaaaccatgaacaaaaataataaaccaggagaatcatgtctgaaaaaaagatatcaaataggtagaaattatttaaaaaccatgaattttggacctgaagagtataataactgaaatgaaaattcactagaggatttcaacagtatatttaagcaagcagaaaaatcagtgaactaaaggataagtaaattgaagttattccatctgaggagcagaagaaaaagtaagtagaactcagatacctgtgggatgccatcaagcatatcagcatatgcacaatgggagtcacaataagaggagagagaaaggagtataaggaatatttgaagaaataatgttcaaaaacttctcaaacttataagacatgaatctacacatagaagaagctcaaggaactaactccaagaagaataaatgcatagagatccacaccaagacacattataatcaaaccataaaaagacagagactcaaaatcaacaagagaaagtgacacctcatgttcaaagcctctataataagattaataacccatttctcatcagaaaccatgatctccagaagccagtatgatgacatatttaaagtaatgaaataaaaaaaacctgttagccaagaatcctatatctggcaaaaccatccttcaaaaatgaaggagaaattaagacattcctagataaacaaacactgagggagttcattgctagttggcctgccctacaagaaatacaaaatacttcaggcagaagtgaaaaaacactaaatcttgaagccatataaattaataaagaacactggtaaagtaattacataggtaaacacaaaagccaatattattgtattattggctcataactcctatatgatttaaagaaaaatgagtaaaatagttacaaatctatgttaatggggcacacaatgtataaagatgtaatttttcaaatcctaaagggaggaggacagagatacgggagcaggattttttatattttggaagctaggttagtattaattcaagctatattaacttctttaatgtattacaatatagtttgaattaatactattcaacacttttgcatctttaaattttttcataataaaatttggaaaaataggccagctgtggtagctcacatctgttatcccagcactttgggagggtgaggcaggaggattgcttgaggccaggagtttgagaacagcctgggcaacatagtgagaccctgtctctacaattttttttttaattagctgggtgtgatggcacatttttgtagtcctaactatgcaggagtctgaggctggaggaccacttgagcccaggaatttgaggctgcagtgagccaagatcacacccattgcactccagccggggtgacagagtaagaccttgtttcaaaaaagaaaaaaagacgttaactgtataccacagggtaatcactaagaaaatatacagaaaagggaataagaagaaaaattaaatggtacactacaggtcgggcatggtgactcacgcttgtaatcccagcattttgggaggccaaggtgggtggatcactttaggtcaggagttcaagaccaggctgcccaacatggtgaaactctgtctttactaaaaatacaaaaattcgctgggcattgtggtgcatgcctgtagtcccagctacttgggaggctgaggcatgagaatcacttgaacccaggaggcagaggttgcagtgagctgagatcacaccactgcactccagcctgggtgacagagtgagaccctgtctcaaaatggaaaaaaaaagaaaaaggtacgctgcaaaaacatcaaacagaaaagaaggcattaatcaagagacctaggaaagaaggcattaatcaagagacctaggaacaaaaaagataagccatgtagaaaacagatcacaaagtgaaagaagcaaggccgttttaaaatcaggaattaatttaaatgcaaatagattaagctctccagttaaaaggcaaaaatggacagaatggataaaacagcatgatccaactatatgctgtctataagagacttatttgcaatccaaagacaaaaaatgttgagtgaaaaaatggaagaaaattattccatgcaggatgtaaaaaaagagaactgaagtaattgtattaatattagacaaaatcgacttaggtaaaaaacttgacaagagacaaacaatgacattatatattgacaaaagagtcaatccatcaagaagatataacaatacagacattacacagctagtccccaaatatatggtgtgaaaattgatggaactgaagggagacataaatatttctacaatgttttcagacttcagtatctcactttcaataatggatacaacaaccagacaaaagatcaataaagaattagaggatttggaaacataaaccaaactcctagcagatatatacaaagcaccccacctaaaaccagcagaatacatatttttcttaagtggtcatgaaacattttctgggatagatcatacattaggccacaaaacaggtctcaataaaaataaaaaatctcacgtatcaacagaaagataaagtcacatgaaatgtattctcaggccacaaaaaaatgaaactcaaatcagtaatgaggaaaactggaaaattcacaaatgtgtggaaattaaacagcacactcataaaaaccgatggggatagaagttacagggaaattagaaaatactttgagatgaaaacaaaacatgattcaggattcctttggtgctaaaataataaaattctgctgactgagctaaaaaaatttgtgatagaaaatatcaaaggcagttccccactctatacacaatacccacccccataacttaaataaaacaactttctcctttctagagaaaatcacattggaaacaaagcctctgcaagaagtcctgatatatgtgcttttacaaggctgctaaatattacttcatttttgataccacattgacttgatctattgatgatcattctattgcatttatcatctcaagagcaagctgagtggatacaaaaaaaaatttaaattgaaataagggaagaagcattttcaagatataatttagatgttgtttttttccaaattacaatacagttggctcttgaacaacacaggtttaaactgcatgggtccacttatatgtgaattttttttcaacaaatatattgcaattttttttggaaatttgcaacaatttgaaaaagctcacagataagccgtgtagtctagaaatatcaaacaattaagaaaaatttaggtatatcatgaatgcataaaatatatgtagatattagtctattttatcatttactaccataaaatatacatgaatctattaaaaaaaggtaaaacttataaaaacttacacacacaaacacagactgtacgttcacagtcaagagaaatgtaaaacaaagatgcaatattaaatcaagcctgcataaagttaactgtagtacatgctgtgctactgtaataatttaatagctatctcctgtcactgttgtggtgagctcatgtgtgtaaatatctgcttaaaattccaagtaatgctaatcatctcaaagtgagcagttcatctctctagtaaattgcgtattacagtaaaaagtgatctaaaggtttcttattttttattgtgtttagtgcaatactataaaacttgaatactaccatgggacctatgtgaactgccactagtgatgttgcaagtgctcccaagatgcatagaaaagtcatgacattataagaaaaagttgaattgcttgatatgtactgtagaatgaggtctgaagctgcagctgcctgccatttcagaaagatggtttattttgtaaacagatggtgtaaacttacagtatcaataccgtacagaactgtaaatatttctcttcttcttgattttctttttttcttttttcttttttttttggagctggagtctcactgtcgcctaggctggagtgcagtggcacgatattggctcactgcaacctctgcctcctgggttcaagcaattctcctgcctcagcctctggagtagctgggattacaggcatgtgccaccacgcccagctaatttttgtatttttagtagagacggggtttcaccatgttggccaggctggtctcaaactgctgacctagtgatccacccccccttggcctcccaaagtgctgggattacaggcgtgagccactgcacctggcccctcttggtccctcttggctgggcagggcggtagcctgtttccgctcgggcattctgggaagtgtagtgcagaagccgttgcaaccttgtgtacttccgctgcaggagggcgaagcagccgtcatctatcccctctgggaggtgagtcagcgcggaacctctgcatctacggcgagctttcctggcctgggcgttggactcgcaggtgcctgccctcgctctcagtgaagggaagtcgcagagggcggggacgacggtttgcttgccctttgtttttagggcggtgcatgggtctccaagttgggaatggctcctggtcgcacgtttggtttgaaggtctcccgggcgctcaagttccctcgccttccccaccttccacacgctctgctgtcttctggcaatataatcttggtagtttcttaatttctccgtttctcctctgtaaagtgagtttcatagtagtacctaactggtaggggtttcgtgagatttacttaagataaatagatgtaaaaatgcgtaggaccgatcctgacacacactgaaaaggtggctggttgttgccaatctgttatttcttcctggagaggagaggcattcagtctctgaaagcttctgtgagcccgcagtgggttctgagctccaggtgcagcgctactcgcccttctctgatctctgcacctcgcgaggctgttcctggattcctaacgtggggggacgggggtgtcaattttctctccatcttttttatttttccttcccttttaaggcatgagtgtgtctcacctccatgtggtgcctggggatgtccactgtcattcatcctggaccagaaacagagtttagatatcttccaacctcctttccttcctcagccttgactaaccggagggctgcagagaggagggtgttgaccccctggctcttggtaacattgtcccaacgtgagaggacttaatatatgctattgctatttctgcttagttggagaacagatttcccacactcattagcaatattatttttcctgctgggcaaatgctcaaatatttatggaataaatgagaggttggattaggcatgtgttcgtgaatgagtaataataaaatttgttaatacgttgagtgccagggtctcttctataggctttatatgcattaattagcttaatcttcagaacaaagataatattgtaattcctgttttacagatgacaacactgatgggtaaaacatttatcttcccaaagtaaaacaacaggaaagagcctgaactgggagtttgagctcaggctgagctcaggcagagtgggttcttgacctttgtgccactctccttcagccctgagaaatgtcagtcccatgggggtgcagtgactcacgcctgtaatcccacactttggaaggctgaggcgggaggatggcttgagcccaggagttcaacagcagcctgggcaacatagtgagactccatctctacaaaaaaattaaaaattagccacacacctgtggtcccagctacttgggaggctgaggcaggaggatcgcttgagcccaggaggcagaggttgcagtgagctgagatcatcccactgcactccagcctgggcaagagagtgagagtctgtctcaaaaaaattaaaaagaggaaaagaaatggtttcacagtttaggcaatgactgggggatgctcaagagtcataataaaaaaaatttttttaaggatttgcagggaagaactctgaggagatgacatttgagtaaatacctgacactgctattaaaataaataaatagatagggtttacattatccacagtctatggattgacccttttatgaatgatttcactttttttttttttttttttttgagactgagtctccctctgtctcccaggctggagtgcagtggcacgatctcagctcactgcaacctcccactcccaggttcaagtgattctcgtgcctcagcctcccgagtagctgggattacagatgcccgccaccatgcctggctaatttttgtatttttaggagagatgaggtttcatcatgttggccaggctggtctcgaactcgtgacctcaagtgatctgcctgccttgacctcctaaagtgctgggattacaggcgtgagcactgcgcctggcctaatgatttcacttttaaggatgaccttgatgttgcttgagcaaagcaaatgaaattaaaaacgcagaagaaattgacatataaagttcatcctctcctcctcccaattaatttaatagcctgagaattttgtagcttaaaggaatcttggagatcaattagtacaatccttgtctgactgtgtgtcattctttgattctgtgtgcatcaaatactcactatattctaggtgcttggggtaaaaagatgagtaatgttcattatctcacaggcaaaacagatgcttgatttactaattataccccaaatgccccagctacgctgaaggcttccaagaggagggattacaagagaaggacagggaagctggtcctctctggaggcagagtggcaggagcaaaggcacgagaggacttgacaacctaggaatgaacaaagtctggaaattcaggcctcgaaaagtggccctggtacatgtagtgagcagagctgagccaggcaccccaaaccccatttgtttttttctactaaatgtcgtgaaatgtcaagtcttgcaaaatcctgttactgagcagagcaggagggtgcaggtaaatataggaccagaacaaagggaattggatattaaaaattgatctctctccctagctttcagaagagaatacattgctctcgtccctactagagtgtttctgcctgaagtaggaggacccacgaacaggagtagctatctgtattgaatgctatcttgtatatactcactgaaacctcttaataaccctacgaggtagatactgttattgtcctcactttatgggtgaggaaataggcacaaagagctagtaagtcagaagagtcaattaggatattaggttcctcatcatctggctccagtatccctcagcagatcattttcagcagttcataccctccaacttccccttctctgatctctaagacatgattccttccatgtcttcatatttctgattagagaaggagacacgattaagagacaggctctggactcagctggattcagatgcagtctcacctcaccagctctgtgaccttgggcaacttaatctcagtaatcctcagcttcctcatccattaaatgggaacgacagtcatcatatcatcacttattgagagcttatataatgtgccacagacagaaccaaggcttttaccccatttaaaaaattgagtcataattcatataccatataattcacccttttaaagtgtgcaattcggtggtatttagtgtatccacaatgttaggttgtacaaccatcactattttctaattgaagaacatttgtatcacccccaaaagaaacctcatatgccctagccatcactctttactatctcttctctcagcccctggcaactattactttttgtctctatggtttagcctagccaagactattcgatttgctcattaatccccaaagcaactgtaaattagaatctgttattagtactacagtatttttcatttaagtgagacagatactgtcaaacttttgtttaaaaaaaagctagcagagacacattttaaattagtatttccttacgacagtgagcacgggaaagggagatacaccattgagactctcctggctacatgaagaaaattcataagtatttataccttttacaaaactgaatgctgatatcaattaaatattataggacaacaaagtagtaagtaatatagccaatcagaattatagacttttcagaggtaaaggtgaatttcataagataaagcattgtacagtctttgaaatctggatgttataaaagactctcttattggaaatgatggcaaaagacatttgcaacaacaattttatgatgcataatatcatctgcttttctgcagcttgcagggaaatcagttatacgagtttccatctgttcacacatttaacccttacaataatcttgcaagaaagcactatttttctcatttgcaggtgacaaatttgaggaatggggaggttaattagcttaaacagagttagtagccatgccaggatttgaccccagaccttgtgaccccagaatccacttttgtagccagtacattctgctgcaagtagctgggattacaggtgtgtgccaccacacccagctaattattgtatttttttgtagagatggggtttcgtcatgttgcgggctagtctcgaactcctgagctcaagcaatctgcctgcctcggcctcccaaagtgctgggattacaggcatgagccaccatgcccggccaccttttaaaaattcagccagcacagccatgtgggctagggcctgtttctcatggcttctttctcttttcccagttctgccttcccaggaccctgcccttccccagaaggagcaggagaaaatgaccaagtttcaggtgagttgagttttgatttttatctcttaaaatgacatctcttttcctcaaagattagacacttttttttctcttccttgggaaagataaaggaggaaaacaggtatttggaatctgctagttacttgattttcgattggttcaattttttgtttatgtctttagcttttgttttggtagttttattttatcatctttatttcacaagtagtagtgcaaaaattcgtagatatcaaaaaatgggagaaaacctccacattactacattgcatacaaataatctatttcccccatactattttatatgtatttacatattgtatgtcttatatctatacttgtcagtgtattttaaagaactacaatcacattctatatacaattttcttttttcagttaatgttgttactagagttttatatgatttagtgttcctttatgtatttgtctcagaagggttttcattttttgtctaatttttcagaggctacaaaacaaacacacaatgctgtctctaaatagtatttcaatttgcaagactttttcatggggctttaaaaatgcaatatttacttacaaaaattatatatatcttaagtggtcaggtcaataacagttttatatcccacttcgacagttgtataattgcattagcccaccattcagaacaagatatagaacatttatattaccccaaaaaggtccctcctgtctctttcaagtcagttccttactccccagaggcatcctctgttatcccttacccccttctcaccctttccccctgaggccctaaagtccattgtgtcattcttagacctttggatcctcatagcttagctcctacttatgagagagaacatacgatgtttggttttccattcctgagttacttcacagagaataatagtctccaatatcatccagcttgctgcaaatgccattaattcgttcctttttatggctgagtagtattccatcatatatatatacacacacacacacacacacacacacacacacacacacacacaccacggtttcttttcttttgtttttttttgagacggagtcttgcactgttgcccaggctggagtgcaatggcgcgatcctggctcactgcaacctccgcctcccaggttcaagcaattctcctgcctcagcctcccgagtagctgggattataggcacctgccaacatacccagctaattttttgtgtttttagtagagacggtgtttcaccatgttggtcaggctggtcttgaactcctgacctcgtggttcacccacctcggcctcccaaagtgctgggattacaggcgtgagccactgcggccggccacacagtttctttatgtactcattgattgatgggcatttgggttggttccacatttttgcaattgcaaattgtgctactataaacgtgcatgtacaaacacctttttcagcgttgggactaaattgacccaacatttctaggacaatttggtagtatcagtcaagttataaaatacgtattccgtgtgattcaagatttacagtgctggggcatttactgttggaatacttacaaatgtcaccaaattaaatacacaggggttattttttagtagcacacacttttgatgtgactgtggaaaagtagtctatgagattggcatgtgggatggagaaaacgaggaagctacttaaagttcattcgaggccctcacaatccagaacgtcttcctgcctgttctttctacctgctcagtgctgcctctctcccagcagttattggccataagattgagattacatctgcttgatgttgtaggagatggtgacattcaaggatgtggctgtggtcttcaccagggaggagctggggttgctggaccttgcccagagaaagctgtaccaagatgtgatgctggagaacttcaggaacctgctgtcagtgggtgagcacaggcaccttctgtaactgaatatcagccctctggactgtcctgctttcaattatttaagactttgggacgcttaaaatgcttccctgaacttggggatgtgaattttctaattcctcagggacatcttgtctataccttgtctatttttctcaaattgcagttgtgaaatcttggtgggttttgaaatcagttggtgagttacattattattgtgtttaatgaaatgaagtagaaatattatagctccttgtcaggaactgcattcagtgcaacgaaaattgtaagtaaaaacaggaaagaagatgtgataaaagtagataatggttaggatcaaattatctgatcacttgatttcagtgatttacatttatgtatttgtgtaccggatcacaaattaaaaggtattcagacaatagctcatgatcacaattttgaaaaatactacttagagcgcatgaaaatggtggtgttggaattaaaatttttgactataatgcattcactttatatatatgccatttctttttcacaggctatcaacccttcaaactagatgtgatattacagttgggaaaagaagacaagcttcggatgatggagacagaaatccaaggagatgggtgttcaggtgagaaccatggagctctgagtctttgcggggtacagcctagtcctctcctcctcaccacctcctcagccaccagcctggcccaagaccccagaattcatcgccctggtttactgcagcagcttgcacatgaccttcctccttctacctccctccagtccattctccacatagccagatcatgtaagtcagatcatgtcgctccttggctcaaaagccttctgtgacttcccatctcactcattaattccaaaatctctacgagccttcagggtcctatgtgacctggtcacccactccctgtgaattgatttcctatcctttgcttttcactcagttctttccagccacacaagactgctgtgtgtttcttatacatgccaagggtgctttttttttttttttttctttaagacaggtctcactctgtgacctaggctgaagtggtggtgcaatcatggtacactgcagcctcgacctcccaggctcaatcgatcttctcacctcagcctcctgagtagctgggatgggactacaggcacttgccactatgctggactaattttaaaactatgtatatatacatgtttttttttttttggtagagatgaggtctcaccatattacccaggttggtctcaaactcctgagctcaagcaatcctcccacttcagcctcccaaagtgttaggattacaggcatgagccactgtgcccggcatacatgtatttctttctacctgaagccttttgctcttctgtctgcctgggatgttcttacctcatacatcctcttggctcccagcctacttcctttatgtctggtcagatgtcatctcatcacagaaacctgcttttttttttcttttagacggagtcttgctctgtcgccaggctggagtgctatggcgcgatcttggctcactgcaacctctgactccctggaaaactgctttgactaccctgtttaaaatacctatccttggctgggcgtgatggctcatccctgtaatctcagcactttgagaggccaaggtggcaggatcactcgaggccaggagtttaagaccagcctggacaacacagtgagaccgcacctctataaaaaaatttaaaaaattagctcacagctataactgtgccactgcactgtagcctgggcgacagagcaagaccctgtctcaaaaatacatacatacatacatacatacatacatacatacatttaattaaattaaatacccatctctttattctgcctttgtgattaatcatcaatcatcagctgacatattcatgtattacattttgtttacttttctatggtctctttccccattagagtacaacttcatgaacgtaagaattttacctgttttcttttcatttttctttttcttttcttagagatgggggtctggctttttcacctaggctggagtgcagtgatacaatcatagcttgctgcagctcaaactcctgggctgggactacaggagtgcactactgtgcccaacactaatattacctgttttaaaattgctgatccttattgcctttaataggcttggcacgtaatacctgttcatttaatatttgtcgaatgagtgactgaatgagtgaatgaatgggttaatggaccgatgtcagtaacgtcagttaatggactaatggataggtgttttcatttgaatagtactgtaatggctccctcacagatctcccaacctgtggtatctgcgagacttttggtgagagttgcctcatccatacacccagtgacaacctccctgttctgctttcacccctctccttctattctttctcttccttatttcattcccccttttcttcacttcttccttcatttatctttaatttgaatatacatcataaatacctaaaatacactaattaaagtcattcctacttgatagaagcaccaaaacgcaaaaactaaattaaacaaacaaaaaaagcaaaccaaaagcccaggagaatctctctgcttatctgagagagacaggccctggattttgtaagtagctggagtagtaaaatctttccaatcttcttatcttttattttcttgtatctccatgctccatgaacgttgactgcattgcaatcaggaatgttggatgctgacttctttgactgactgcctcatttttaaaaattttctttttttgtttttgactgcctcatttttgtgtataaacctaaaacttgggaattatgatcccagttattgccattgtcctttttttttttcttaacaggtagcttcttcccaacttcttctttgcctccttagcaaatcttgactgtttttgttttttttttctttttttgagatggagtctcgctctgttgccaggctagagtgcagtggcgcaatcttggctggctgcaacctctgcctctcaggttcaagcgattctcctgcctcagcctcccgagtagcagggactataggcgcatgccaccacacccagctaatttttgtatttttagtagagatggggtttcaccatgttggccaggatggtctctatctcttgaccttgtgatctgcccacgttggcctcccaaagtgctgggattacaggcatgagccactgctcccggccacaaatctttactttttttttaatttttggccaattttttattgaaatatatacagaaaactgtacaaattgtaaatgtatagctccctaaattttcaggaagtaaaatggcttgttttacagctcttttttattgaggtaaaatttacatgtgcacaccttaagtgtgcaatttgatgagttttgacaaaaggatataactatgtaactcacagcccttggaaaactgaacaaatctgacagcgtattctaccctcacctctctttattttttggcaaacatcagaattttttagggtttcacattctgcttatccacctacgtacccagctccacctatacaaaatattcctgaggtctattttcactggacagaagtacaaattaaagggcatcttctccctcaaggatcaatgaaacaaaatctcacagagtatggtgctaagtggatctcactgtcttcacttctcattgagagagttcacaggcagagaataaagaggtgtcactaaaggactatttcagaacatagttactcttctgatgttatgttcagcctacttataatttttatgacacctgtgttagttatcaattattttataacaaattactgtgaaacttagcaccttggccagttgtggtggctcacgcctgtaatcccagcactttgggaggctgaggcaggcagatcacctgaggtcaggagtttgagaccagcctggccaacatggtgaaaccccatctatactaaaaaaaaaaaaaaaaaaaaaaaaattagccaggtgtggtggcaggcaactgtaatcccaactactggggaggctgaggcaggagaatcacttgaaccccggaggcagaggttgcaatgagctgatatcataccattgcactccagcctggggaacaagagcggaacttcgtctcaaaacaaaacaaaaaccttagcaccttaaaacaatgaacattggtttatagtttctatgggttaggtatatgggagcagcttagcttaaccctaagtgagggttctcactccggatctcaaaaagctgttaaagagtgacggagctgccgtccccggaaggctggactgggactgaaggacctgcttccaaggggggctcgttcacatggctgtggcaggaggcctcgcttccttgctaagtgaaccattccctacggctgctgaagtgtcctcaaaacatggcagctagtttctcccagacccagtgattcaggagagtggaagatagaagccacagtgtttttatgacctagcatcagaagtgacagatcatcacttctgccatattctattggtttcacagaccaaacttgatacagtgtgggagggggcttcaaaagggaatggattccaatggggagtgatcactggggaccatcttgtattagccatttaggtttatcagaaaattcagtcaaaccaagtggcaacaattatcaatgcctttactcctatagggtgtgtcagctatgggaataagttttctaattctttttcatttatcatgttcactaattgaatattatatacttagaacctcattgaaaagaaggagaattctctcaaatctagctcatcaaatgtatgtttaaggactaaattaaggaaataatggtactatcttatgggttcattctcaagacagagaagatatttttctatattctcttcacttttgccaaggatgtcccctctttctttctttgagaattcttggcatcactaaataatccacttgtgaatgctgaaggagagattcaggcttttgtaaccatttttgggctttatcatatacagatgcaggttgtacaatgtaaccatgattctgaggctcacatatagccaggattttgtagattttatacatctgccacggaaaagaggagaggatttttttttttttttgagacggagtctcactctgtagcccaggcttgagtgcagtggcacgatctccgctcactgcaagctctgcctcctgggttcacaccattctcctgccttggcctcccgagtagccgggactacaggcgcctgcccccatgcctggctaatttttctgtatttttagtagagacggggtttcaccatgttagccaggatggtctcgatctcctgacctcgtgatccacctgcctcggccttccaaagtgctaggattacaggtgagagccaccgcacccagccaaagaggagggatttttaagtgattattcttatggacaaggaggtaaagtttctcctctacaacgtctttctagggcatctttttgttgctctgtagcctgtgtatttgaccacatacataagtcttggtattggccaggcatggtggctcacacctgtaatcccagcactttgggaggccaaggcaggcagatgacttgaggtcaggagttcaagaccagcctggccaacatggtgaaacctagtctctactaaaaatacaaaaaaaattaatgaggtgtgagtggaatgcacttgtagtcccagctcctccagaggctgaggcaggagaatcacttgaaccccagaggtggaggtttcagtaagccaagatcgtgccaccacactccagcctgggtaagagagtgagactccatctcaaaaaaaaaaaaaaaaatcctctcctcttttccatggcagatgtataaaatctacaaaatcctggctaatatgtgagcctcagaatcatggttacattgtacaacctgcagtctcaaaaaaaaaaaaaaaaaaaagtcttggtatagctctaaatgggtctcattaacattttagtatataaaaagccaaccttttttgttcgccataggttgaaaaaaaccaatgatagtctgggtgcggtggctcacacctgtaatcccagcactttgggaggccgaggcgggcggttcacgaggtcaggagatcgagaccatcctggctaacatggtgaaaccccgtctgtactaaaaatacaaaaaaatgagctgggcatggtggcaggcgcctgtagtcccagctactcgggaggccgaggcaggagaatggaatgaacccgggaggtggagcttgcagtgagccaagagcacaccactgcactccagcctgggtgacagagcgagactccgtctcaaaaaacaaaaaaagagaaaaaaaaacaatgataaagtcaagctgaactctccactggtttattaaggtttcccaatgtggtcaacctgtgaaatgtttttttatttctgaacaaatgttcagttgtcttcattttcatttctgagttctctttatcattctaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccacataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacaaaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacataaaaccaagcagtctacaatctgagtaatgtttttgcaattggcttctgtcctcagttcagcttcattttccaagcagtataataggccaaagtttctatctgattatttaagactttttccatacagtgtacagctgtgctatgtttctttggcgggggcttttgctatctttctttttgggagctagtgtgatagaaacagactgaatgaagaaaaaaatcccaactggtttttagttccataaagcttcatgagaaaggttttgcaaaaaaggggaatatcatatggcatgcattttagatgttaaactaagctgttaaggacacagcattttggacaacaccccatacttctcagacatcattacacgttatgcagtgtgtaatgatcaaatcatagtaattggatgaagggtttactcaggtgtatatttagtggaggtgggagaaagtttcccactgttgtttttttttttttgtcctggaccttaccttccaggacaatgaatacttaagttccatgatacctcatttcatgctaccatcagaaatacagggccaataaatgaaaaagaaaaaataaataaaaaagataaaaacaaaaaaagaaatacagggccaataatgctttgcttcatcaccaccagattactagggtgggctgctggagcacatggttgtttaaatcaagatgttttcaattgtgagaaatggaaaatcacactccaactagctggaacaaaatttattggtatgcatatttaaaaagaagaggctgggcatggtagcttatgcctgtaatcccagcactttgggaggccgaggcgggcagatcacaggtcaggagtttgagaccagcctggccaatgtggtgaaacccagcctctactaaaaatacaaaaattagtcgggtgtggtagttggtgcctgtaatcccagctactcaagagtctgaagcaggagaatcgcttgaacccgggaggcggaggttgccatgagccaagatggcgccattgccctccagcccagggggccggtatgagactccatctcaaacaagacaaaacaaaaaacaaaaagaatacaggtaggacaggaccaggtctcgttgaaacagggctctgggtcaattcttctgtgattccctcacctctgcccttctggttgagttgattcccacatttgttcattccaacctactgaggaaatttacttaaagaatagatgctcagttaacattctcatatcacacactcccttttctgtgcacttctaaagcagttattttcggaacctctttttgctcttaatcatgtagagacttttcattttcctaaatatatcatacctaaacaaataactcatagaggtactgtgggttatggtttgccatttgaaccatgcatcaaccttctggagaatcttttaaagtatatacatttttccagagtaaaattaatttttttctaaaacacgtgaagtagtttttattaatatattaatagttgtatatatttatgggatgcacgtgatattttgatttgtgcacatacaatgtgtaatgatcaaatcatggtaattgggatatgcatcacctcaaacatttatcatttctttgtgttgggaacattctaaatcttctagttattttgaaatatacaacaaattcttgttaactgtagttgccctactgtgttattgattagctataataaataagttctagtgttactgacactgttctatctgatcatatttttgtacccattaaccaacctctcttcatccttccctcacccctatccatcccaacctctgataaccaccattctaaatcacttcctccttgagatcaatatttttagttcctatataggaatgagaatatgcaaaatgtgtctttctatgcctggatgattccacttaacacaatatcctctggttccatccatgttgctgcaaatgacaggagaaagaaaatgtggtatatacacacaatggaatattatccagccattaaaataataaaatcctgtcatttgcagcaagagattgtctgatttttgtttgttttttatttatttatttatttttttgagacaggtctcagttgaccaggctggagtgcagtggcacaatcctagttcactgtagtcccaacctgccagactcaagcaatcttcccacctcagcttcctgagtactagggactacaggcatgcaccaacatgcccagccaattttttgtaaagatggtctcaccatgttgcccagattagtctcaaactcctgagctcaagctattttcctgcctcgacatcccaaagtgctgggattacaggcatgagccactgcacctggcctgaataaagaattttatctatatatacttggtctaaacagaaaaagacctgcaaagaaatcatgaacactaacaaagtttgttatgtgcattcatgttagttggcaactccaaaactacttgccaggtattggaggactgaacagatgcataaacatactgatgatgctgggggccaatttctgactcttggagaaagaagtaaatatggaatgggaaaatcccttaggaagaatcctgcaatacttatttaaaatgagaggggtcagtattttacacagacacagacacacacacacacacacacacacacacacgactattatcccaataatgattagtatgcacagcacccagatcttggtttctaagtatcattccccactaaaagcaatcagagctctacagaatctgtggctgaggcagggaatatacaagataaacctaatatcttactgtaccagaaaacaaaggttcatatggatgacagacaggtagagagacatgggggtaggggaaggaaaagctcttctaacaaacagtaggatgccaattactaaaaataaaaggaatgacggagtcagaaagtcatattttgcagtcatcacagtaataactgattcagacaagaatcatcaatgaacactaaaactagtgggtgaaagacgagatgataacatagtctcaaagatcttcccacaaattgcttattaatttcaaagccaaaatagcaattttttagtggaaaaacctaggagacaccagttcacacaagttatcaacgctaacgccaacaaaacacatcatgtgtttcctattgtgatgcactgacaagtatgcattagtcatgcaatactcaatctacaaacatttaacttgaatctaatcatgaggagtcaaactcaaatttagggttgttctacaaaatagcttgttgtcttcaaaatgctcatttcatgaaagacaaaaaatggctatggaactgatccaggttgaagactaaagaaacatgacaatgaaatgcaggcatgatacattttagattggaccctgaactagaaaatgctataaacattataggacaactgtggaatttaaataaactctgcagattaggaaacattactgtttctttttctttttttttttgagatggagtcttgctctgtcgcccaggctggagtgcagtggcatgatcttggctcactgcaagctccgcctcctgatttcacgccactctcctgcctcagcctcccaagtagctgggactacaggtaccaccacagtgcctggctaattttttgtatttttagtagagatggggtttcactgtggtctcgatctcctgaccttgtgatccacccgccttggcctcccaaagtgctgggattacaggcgtgagccacaacgcccagccaacattactgtttcaacctacaatggtcttaaaatatgtttacagattattttactacccccttgattgtagataggcttttgactgtctcaacaaaccgaggcagaagtgatgttggaacttccgaggcgagattaaaaagggtcatagtatttgtgctggcttttatctggatactagctttgagccaccatgtaatgtccagtttctgtgaagtcaccatgctgaagaggtcacagagagatagaaagacatgtctgagaaaccaaagctgtgtcattctctcagttcaggcagtagatgtggaaatgaacaggtctaactgcaatcacattagagaccccaagaatatgtgggattcttttgtattattcttgcatcttttcttaatgtttagaattaattcaaaataaaagttttagaactttaaaaaacattacaaaaatgttaaaaattactacacgagcccccttaaagtaacaagatcatatgtgtacatatatacgcatatcacatacacatatatacacactcatacaaaatcctgtctctgcccactttcctaaacatattctcagtaactaccaacgtcaataattataaatgtacctcctctcatttcactctgtattccactgaatggataagtcatcaaatattttgtcaatccaactgataaatgcaaagtttgctattatcaacaatgcaactgtgaacatccatttacacacatctgtaactgcgtgtctcagtcttcaaatgcatcttaaaagttttctccctttccttcctgatatggtttggctgtgtccccacccagatgtcatcttgaattcccacatgttgtgggagggacctggtgggaggtaattgaatcaagggggcaggtcttttatgtgctgttctcatgatagtgaatacatctcacgagatctgatggttttagaaaggggagtttggccaggtgcgatggctcatggctgtaatcccagcactttgggaggctgtggcgggcggatcacgaggtcaggagttcaagacaagcctgactaacacggtgaaaccctgtctctactaaaaatacaaaaattagccgggagtggtggcacatgcctgtaatcccggctattcaggaggctgaggcaggagaattgcttgaacttgggaggggaaggttgcagtgagccgagatcgcaccactgcattccagcctgggtgacagagcgagactctgtctcaaaaaagaaaagaaaagaaaagaaaagaaaagaaaagaaaagaaaagaaaagaaaagaaaagtggggcggggggggagttgttctgcacaagctctctctttgcctgctgcaatccagagactctgtctcaaaaaagaaaagaaaaaaaagggggggtgggacttttcctgcacaagctctctctttgcctgtcatccatgtaagacgtgacttgctcctccttgccttccaccatgattgtgaggcctcccagccatgtcaaactgtaagcccattaaaccctttttcctgtataaattatgcaatctggggtatgtctttatcagcagcatgaaaagaaagagacacagagacaaagtatagagaaagaaaagtgggcccaggggaccggcactcagcatatggaggacccgcgccagccctggtctcttgagttccctcagtatttattgatcattatctctaccatctcagagagggggatgtggcaggacattagggtaattgtggggagagggtcagcaggaaaacatgtaaacaaaggtctctgtgtcataaacaaggttaagaaaaggtgctgtgctttgatgtgcacgtaaacaaacatctcggtgcattaaaaagcagtattgccgctagcatgtctcatctccagcgttaaggcggttttctcctatctcagtaaatagaacatacaatagagttttacaccgagacattctattgcccaggaacgagcaggagacagatgcttcttcttatcacaactgcaaagaggccttcctcttttactaatcctcctcagcacagaccctgtatgggtgtcgggtgttgggctgggggacggtcaggtctttcccttcccacaaggccgtatctcaggctatcacatggggagaaaccttggacaatacctagttttcctaggcagaggtccctgtggccttctgcagtgtattgtgtccctgggtacttgagattagagaatggtgatgacttttaacaagcatactgccttcaagcacttttttaacaaagaacattctgcatagccctaaatccattaaacattgagtcaacacagcacatgtctctgcgagcacggggttggggctagggttacagattaacagcatctcaaggcaaaagaatttttcttagtatagaacaaaatggagtctacttctttttacatagacacagtaacagtctgatctttcttttccccatagtaaaagctattggatctttgtttgtatatgtgtgcacatatttagatatgtttatgtgattatattgttacatgtatgtaacatgtattatgttatgtgttggtctagcatgataccaaatggccttgtaagtagataattataaattaggtacaaatgcttttcaagttcacacagatcttcagtaaataaaactggttttaaaatcattagtaagataaaaatgtcttcagaattgtcagcatacatttttgtctgggcaaataagttttatagttttatagttgccttggctaaatgttttaaggtgtcacagtttggcacaaaggttctgagactataaacccaactgaaaacagagtaatctttgtgtattttttttgaaaaataaaactaatttaaaatttttagtttaatgaaaacagctaaatcttctgagttattggcaaaatgcccagtgtttaaggttcttacttagatgtatacctgatattcagattttaaaaatggttaacagggaaataactttaaataatcaccagctttatgtagtatctcagttttcagtactaatctagataagctgttaaaaatgagaaaatatcgagtacatatgagataaatgcttatagactttttgtgtaatttaaaaccctaaaaactttaaattaaataatactcattcaccctttctactttcccatatattatggcacagaatggttgatgacagtgtaaatccacgtaataggtcaagacctctatgaattgaaaataaaatgctactaaaattctagagaaaccaagggccagaccaacagctagccaaaaagtagacagtaactcatgacgtgctgctaaccatccattcatctgtcagactggctggaatcagaccatagacgcatcacactcgggtgaaggcagctcctcctcaacctgatacctcagacaatcagactgcttggtcatgtaaatcaagagaggacctaaagctatttattaaagaaaaatcatacaaataagtaacacccttctgttaacatgaattgttaatgaattgtacagtcgtaactacattctttatctttgctaaaactaacctttttgctgaatgggcatagatggtgactttcctccaaaataaaaggctgttgggtctgcagggagctacccctttctttaatcacaggcttgccatggtgcatacaaactgctaacctgagcacttgagtatttttatacttggagtaaaaatacttacctgtttcccttctatgattagagtaccacttaccatgagttccctgcctctgagaaaacacagaaacgtattttccttctggttcataaacaggttaatgccacccccactacaggatatgccatagatgatggcatatgatggttgatggcagtgtaaatccaggtaatgggtcaagacttctatgcattgaaaaacacagtaacagtacaccccacactatctcccacgatatgggatgactacctcttcaacaatgtggccaaacccttggactgactaataacatgtgactaggatggcacaatcaaaatagcatccacctccataacagagcctcatccttccccctggggtttgctatgggtctgcggcactcatggttggccttactgttggggatcagccttaataccacctgtagggtacccgaagtccagtggtgacaaaggaatgagaagagacaggttaagtgttcataaaggtgggagccagggggccagagcaaatcagaggctgcaaaggcccggagctgaagtctctacactatttattgaatatgatcacttagatctgagaagcagatgttcagggcgaaacagtgaaagggaggcagtgcattatatgcgtgatctatagcagtggcggtttaagtgaatctcctttgtgctcagtgtatctttaacttatcggagagtagctggtgggagcaggcttaactaggagcttgcgtatctgtctacatttcaatgtcttaaaggagtgacttttttcctgaacacagcgtttacagataagagagcaggtctcactctgagcatgggaacatgatggcaattaggaggctttcctcctcagaggcctcttgtggctttccacaacttattgtccgatatttttatggccaatttatgcaggcactccacaagcccttttcccagcacttacaactggaatggtagatgcacctaggggcgcccttccctaccaggatgtatcctttcccatttagactctctccatgccaactgggaaagtgtaaaaggcgagacgatcccatcaaaaataggcatcaaggtggttgtacccagtagtcctttctttcccccaggcagtggccacagatgtaaaattacaaataaaagacctggttaaacaaacggctgctacctttaataatatccatcatgtcatcccctttctcgctgaaaaaccctcacaagattagacaagtcgccctgcacaaccacatggccttagatatcctgactgcagcacaaggcagcccttgtgcactgattaagactgaatgttctgtccgggagcagtggactacagtgcctgtaatcccagcactttgggaggctgaaaagggtggatcgcttgaggtcaggagttcgaaactggcctggccaacatagtgaaaccctctctactaaaaatacaaaacttagctgggcatggtggtatacacctgtaatcccagctactggggaggctaaggcatgagaattgaacttgagaggcagaggttgcagtgagccaagattgtgccactgcactccagcctgggtgacacagcaaggctgtctcaggaaaaaaaaaaaaaaaagactaagtattgtgaatatataccacattattctcacactatgacctaagctatgcatacactggacatccatatttctgatacagatataggatcctctcccaggaccctttaacagtgtggtccagctgacttccttataaaagactttcatatacagtatggttggtattcttctcattgtcctcatcagctgctatggattttactactgttatacactgaggacagactttctcaaaagttcctaggtcctcagtcctcacactgtaaggctccagcaagttcctgctatagatctgggaatgtggatatatttccaactccaagtgaatagattccattctggtacttcccaactatgccccctttcagcaggaagcagccagattaactgcgttgcccactttccataaaaataggatgaagtttgacagtggggaattcttacagagtactccagctttgaaatgcattttaaaacttttctccctttcctccccaatctcagaatgtggccttatatgttaaaactcttcatctctccctttcccacgaggtacttcatgcacagtgctcacttgtataattgtgcttgcttagaaattccaagcactaattttaaagcaaaacagacacagactaaataaatcagctgcacaatcctcccacttaagggcagttatgaacagttcatccaccactcctgggccaaagtcaagaagatgcaaaccagacctccaaatgggtgactgctcaagataaaccatcagaagaagacatgcaagacctgcacccgactgcaccgctcccacgtatttcccacaccaagttttccctcttaaactccttcactcagcccaaaaagttggaatggtcttttaaggtatgagcctggccatttcccaattactaacatttgattagtaaaactgctttccttttactacattttgcttttcatgttttcagcctttgagtagcaagcagctggacttaagccagttacacatccataacacaggattacatgccatataatgagataaaacaaacaagatttagctataagggattttcatttatgcataactttgtttcacttttactttggtaaaattgatgtcactgtaattttttgaaaagttaaaatatcatcccaaccttccatgccacagtaaacaattgttagcatattaatatccttctattatttctatgcatataatcacatcattaggtggacatacttctattaattggataatcccaggaagggtctaacctagttttctcatgaataatgtcttctctagtcattacagacctctgatcatcttaatggctgtatattataaggatatatcaagacttactcaaatattttactttttcctttttgaattcaggataaatatccttgtgtacaatctttctcgcttttgtcacaatctcctaagtgaaatttctagtgctaggactgccagggcaaagagtatttattgtccactaataccaagaggtcttaagcatagaatgctgtgtaagtggtaatccatctaaatcattacactgaatacaatttcaaggttgggcacagaggttcacatccataatctcaacacttcgggaagccaaggtgggaggaatgcttgaggccaggagtttgagaccaacctgggcaacactgcaaggctctattaaacaaaataaataaacaataagatacaatttcaataaagactcaacaggtttcttgccctgccacttccttttaaggggataaatgtgacaaattaacatgcctgaaatctgccaaagctccttctaaagcggcctacatggaggaaagactacacatagaaaagcaacttgacctgaacctgaatgaaaataatgaaaggaaaccaagtattaacaattcaagtttactaagaaactttttgtcatcagtaactacttttaacactttcagagttacagtacagcttagtgtccaaaaattctaatcatgtaaattgcagggtcacattagataaaaacagtattgttcagtctataaactgacactaaaaatcatactgtacacaactgatgatacactgtacaaagaactaaggctgaaggatgggagccattcatgtcttttttccaaatttgtgttagtatggatggcagtattatatacttttcagtacttactgaaactaacgttattaaggctacttgcaggattccttttgaatataaattaatataaatttagagtagaaaacagactagaattttcaagtatttgtcctaattataggtattttcttcactttcttcagtaattgctgggccctattatgagccaagcacaattctacatggtagagatagagtggtgaaaaacacctccttacatagaggttacattttagttgacatccattttttctgtcaatcatacttttgttaaaggaaggcctctctcctgtgcagactccgacaagacttttctgctgtgttacatcttgagaaccgggacacctggtactctgatataaacactgatcatatttacagaacaaagttttctcgcatctgtgaaatatgacgtttgtaaagaattcatgtcctaaccaagtctaaaacacagcatttgagagacttctttcctgtcaagattctttgaagctt

SEQ ID NO: 484 - DNA, 1199 bp, Homo sapiens
gaaaagcttgagaaaccagagaaggagaagaaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgttcgatctgatcgatactttccagtcccgaatcacagatatggacaagcagaagaaggagggccttgtttgcaaagaggaccaaaagcagtccctggagaattcctatcaggtcccgtggaggaaggaagttgacggggaaccccggaccctaaggaatgaagactggggcctattcacagaatcttgccctaaaggtcaagcttcaattttggctttgcccctaatcatttaagcttaaggctgcacacaatatgcgcaggtacaggttccacataggagactctttaacggaaagcaacccccgtgggaaacacccaacttcagggccagataaccaccgttgtgaaggaagacatgcgtacccaaagcgagaacagaaaagccagagaaacgaaggaaacgatatacaacaaaagacaaataatctattttttcacttttttctttcttccttcccccaccaaccaaaaacaaaaaataatacaaaacacaaaaaaaaagacacaacaaaaaacgaacaacacaacaacaaacaacacccaccaacaaaaaaacaacaaaacaacaaccaacacaaacataacaaaaaacacaacacaaaccaaccc

SEQ ID NO: 485 - DNA, 515 bp, Homo sapiens
tttaacagtaaaatttatttttatttttgcatattctcaaatacacatttacaatagtatcacacttcctatatgaattcttcatagttattttaagtattttacaatttgtacagaggaagggacatacaatatctaataggctatttttcaaccaaataataatttatgtccttgtaagattttgtacctctttaaaactttcaacttcaacatccacttttttagctttgctaatcaaattaagaattaaaaccagcctgcaaataataacagtatataacattaagcacaatttcatttctttctttatacaaatgttctatatttacttgaccaaatgcttaattaccttttaaaggtttcaataccgtggttaaaaacaaaacaactgtgtatacctccagactatatgaaaaatatgaaatatgtaaagtgtcacgttttttaccttagtttatttttaaaagataaatagctaactatctgtattaattttaaagaatgttttaaaa

SEQ ID NO: 486 - DNA, 1763 bp, Homo sapiens
gcactggactgagaaccttcaccaaaaaaatgtctgcccagagacagatgaggtccttcagctccagtgctgattggttcttttccaaaggcccatctaatcctaccacgcacggaaatatccacaggtttttattctttctgccagctacatcagatccatcaggtccgagctgagttgactaccactacttttccctttgtctcaattatgtcttggaagaaggctttgcggatccccggaggccttcgggcaccaactgtgaccttgatgctggcgatgctgagcaccccagtggctgagggcagagaccctcccgaggatttcgtgctccagtttaaggccatgtgctacttcaccaatgggacggagcgcgtgcgttatgtgaccagatacatctataaccgagaggaggacgtgcgcttcgacagcgacgtgggggtgtatcgggcggtgacggcgcaggggcggcctgacgccgagtactggaacagccagaaggacatcctggagaggacccgagcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgaccaggaggagacagctggcgttgtgtccaccccccttattaggaacggtgactggaccttccagatcctggtgatgctggaaatgactccccagcatggagacgtctacacctgccacgtggagcaccccagcctccagagccccatcaccgtggagtggcgggctcagtctgaatctgcccagaacaagatgctgagtggcattggaggcttcgtgctggggctgatcttcctcgggctgggccttatcatccgtcaaaggagtcagaaaggacctcaagggcctccaccagcagggcttctgcactgactcctgagactattttaactaggattggttatcactcttctgtgatgcctgcttgtgcctgcccagaattcccagctgcctgtgtcagcttgtcccccgagatcaaagtcctacagtggctgtcacgcagccaccaggtcatctcctttcatccccaccccaaggcgctggctgtgactctgcttcctgcactgacccagagcctctgcctgtgcacggccagctgcgtctactcaggtcccaaggggtttctgtttctattctctcctcagactgctcaagagaagcacatgaaaaacattacctgactttagagcttttttacataattaaacatgatcctgagttaaaaaaaaaaaaggaaatcgctgcagaatgaaggaatatcccttgaggtgacccagccaacctgtggccagaaggagggttgtaccttgaaaagaccactgaaagcattttggggtgtcaagtaagggtgggcagaggaggtagaaaatcaattcaattgtcgcatcattcatggttctttaatattgatgctcagtgcattggccttagaatatcccagcctctcttctggtttggtgagtgctgtgtaagtaagcatggtagaattgtttggagacatatatagtgatccttggtcactggtgtttcaaacattctggaaagtcacatcgatcaagaatattttttatttttaagaaagcataaccagcaataaaaatactatttttgagtct

SEQ ID NO: 487 - DNA, 6021 bp, Homo sapiens
tattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataatagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccataattctgacggatatgaacatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagttttatgaggatacgaacagctggattgaggacactgagtttttgtggggccctgcattacttattactcctgttctaaaacagggagcagatactgtgagtgcctacatccctgatgctatttggtatgattatgaatctggtgcaaaaaggccatggaggaaacaacgggttgatatgtatcttccagcagacaaaataggattacatcttagaggaggttatatcatccccattcaagaaccagatgtaacaacaacagcaagccgtaagaatcctctaggacttatagtcgcattaggtgaaaacaacacagccaaaggagactttttctgggatgatggagaaactaaagatacaatacaaaatggcaactacatattatatacattttcagtttctaataacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacgggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggttacaaacttaattcctatggatttcatccctattacatggctctggaagaggagggcaatgctcatggtgttttcttactcaacagcaatgcaatggatgttacattccagccaactcctgctctaacttaccgtacagttggagggatcttggatttttatatgtttttgggcccaactccacaagttgcaacaaagcaataccatgaagtaattggccatccagtcatgccagcttattgggctttgggattccaattatgtcgttatggatatgcaaatacttcagaggttcgggaattatatgacgctatggtggctgctaacatcccctatgatgttcagtacacagacattgactacatggaaaggcagctagactttacaattggtgaagcattccaggaccttcctcagtttgttgacaaaataagaggagaaggaatgagatacattattatcctggatccagcaatttcaggaaatgaaacaaagacttaccctgcatttgaaagaggacagcagaatgatgtctttgtcaaatggccaaacaccaatgacatttgttgggcaaaggtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccaccttatttcccagaactcacaaaaagaactgatggattacatttcagaacaatttgcatggaagctgagcagattcttagtgatggaacatcagttttgcattacgatgttcacaatctctatggatggtcacagatgaaacctactcatgatgcattgcaaaagacaactggaaaaagagggattgtaatttctcgttccacgtatcctactagtggacgatggggaggacactggcttggagacaactatgcacgatgggacaacatggacaaatcaatcattggtatgatggaatttagtctgtttggaatatcatatactggagcagacatctgtggttttttcaacaactcagaatatcatctctgtacccgctggatgcaacttggagcattttatccatactcaaggaatcacaacattgcaaatactagaagacaagatcccgcttcctggaatgaaacttttgctgaaatgtcaaggaatattctaaatattagatacaccttattgccctatttttacacacaaatgcatgaaattcatgctaatggtggcactgttatccgaccccttttgcatgagttctttgatgaaaaaccaacctgggatatattcaagcagttcttatggggtccagcatttatggttaccccagtactggaaccttatgttcaaactgtaaatgcctacgtccccaatgctcggtggtttgactaccatacaggcaaagatattggcgtcagaggacaatttcaaacatttaatgcttcttatgacacaataaacctacatgtccgtggtggtcacatcctaccatgtcaagagccagctcaaaacacattttacagtcgacaaaaacacatgaagctcattgttgctgcagatgataatcagatggcacagggttctctgttttgggatgatggagagagtatagacacctatgaaagagacctatatttatctgtacaatttaatttaaaccagaccaccttaacaagcactatattgaagagaggttacataaataaaagtgaaacgaggcttggatcccttcatgtatgggggaaaggaactactcctgtcaatgcagttactctaacgtataacggaaataaaaattcgcttccttttaatgaagacactaccaacatgatattacgtattgatctgaccacacacaatgttactctagaagaaccaatagaaatcaactggtcatgaagatcaccatcaattttagttgtcaatgggaaaaaacaccaggatttaagtttcacagcacttacaattttccctcttcacttggttcttgtactctacaaaatatagctttcataacatcgaaaagttattttgtagcgtacatcaatgataatgctaattttattatagtaatgtgacttggattcaattttaaggcatatttaacaaaatttgaatagccctatttatccttgttaagtatcagctacaattgtaaactagttactaaacatgtatgtaaatagctaagatataatttaaacgtgatttttaaattaaataaaatttttatgtaattatatatactatatttttctcaatgtttagcagatttaagatatgtaacaacaattatttgaagatttaattacttcttagtatgtgcatttaattagaaaaagagaataaaaaatgtaagtgtaaaaaaaaaaaa

SEQ ID NO: 488 - DNA, 838 bp, Homo sapiens
catagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgtttttctgcactaatagaaattagactaagtgttttcaaataaatctaaatcttcaaaaaaaaaaaaaaaaaatggggccgcaatt

SEQ ID NO: 489 - DNA, 383 bp, Homo sapiens
tttttttttttttcccccatctgtttgccagaggggtgggactggcaacagaacagccgtggctgctttatctctcctctccacggtgtactcaggcctgagtggtgactcacgggagcctggccacctcgcagctgttcgccccgccaacttttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttaccctcgtgccgaattctt

SEQ ID NO: 490 - DNA, 174009 bp, Homo sapiens
agcttaaacacttaccatctagccctttagagaaaaggtgcacttgaccccagttgagatctgtgccccaggggtccttgtgtctgcgatgccagccctgagagcatccatgtctgagatcccagccccagggttctctgtgttcaagacctgggccccaggccaggtgtggtggctcaggcctataatcccagcactttaagaggctgaggtgggaggatagcttgagccctggagtttgagactagcctgggcaacatagtaagaccccatttctacagaaagattaataaattagccaagcgtggtggtgtgtgcctgtagtcccccactactcgggaggctgaggcgggaggattgtttgagcccaggaaatcgaggctgcagtaagctacactacactctagcctgggccacagagtgagaccttagctcaaaaataaaaaaaaaagatctaggtctcagggtcccccatgcctgagacctcagccccctggacatctccacatttgatagaaattggtctccaatttctccaggtcctggaggcctctgtgcccaagactagggccctggggtgatcttctggcaagagcccagtgccagggtctcagcaggatttgaaacgtttgagaccttaactaggtaagtctcatggcctggggtgtccctcagtgcaagactccatccctgagggttgctgtattcaagacagtagccttgagggtgtctcactgctgaggccctgtcctggagggtttctgtgtctgagaccctgttcgtacagttactacatgtgtgaccccagcttgcggaacccctgtgtgggagaggccagccttcaaacgtctccttcctcctgtgtccattatcaatgtaccgcctctcagcttcaaatacacccgcggagttaagctttgtcaacagagggcgctggagagtcactgaaggagggaggggctcctgttctggcttctagccagtttggtccttccagctctggccagggtgcggggccacattcagcgagtgccactggccgcagctggcttcccagtgaggggttcccttcttgccaagtccagcctgcagaaacctctgtgccacccagtgggctacagctgcagtgagactggactcagccttggggctgattctcccctccttgaagagaaggggccaatttctcccttccatgaggcttttaccttagccctagagtggcggctacttcctgtgtgtgctttggtggtattctttagtgctctctttaccgtttcttatttatgtttatttatttatttgtaaagtctgggggattcccacatcagagactatacccctagaaatcctgatcttccagttaagaggggtccccatatccaatgtcctgccttggtgaggtctccgtgcgtgagactcagaactctgctctctgtccctgcccctgggatcccagtctctcccctgccctttggtgctagtgtctgaaccccaagcccgatcccacacatcagtgttccgctcatgatggaaccctaggctgctgctcttgtattctaaagtcttataggaacctgacctcttcacttacatagtctacggctgctttcatgccacagtggcagagtgagtagctggaacgagaacctacagcctgcgagcttaaacatttaccatgtagcacattagagcaaaggcgcgcctgtccctgccttataccgagggtctctgacatccaccctgagaaaactacctctgagggtccccacagcctggattttccctaagggtccctacctcccaaagtaggtggccctggccctgtgaaacctggtctagggttccccaggtctgcaacctcaatcattagtcctgtgcacctcccgccatggacaccccagttacactacccgcagccccagagtccccatcctccatccctagtcccatcagccccagtcccagcccagcccagcccagcacctttgttgacgcagctcaggatgcctccggagggctggcacacctgccccggcttgcagctgtgttcctggcacaccacgactttacccacatggcacgtgcactgctgccgacagttgtcaatgaggactgtctgctccggctgtggggagagagggaacggccatcagggacaccacgggtgggagccgactctcacatctctggcgttctggcacagaggggtttggcagacatcacagacaagggacatctctcagcaggatggcccgttgtctgtgaagatgaggcacagcatggctttggggccatcattcattggttcattcacttttcttcatttactcattcattccaaaatatccactcaacgtctgctgtaggagaaatggtgtgacacagtaactaagggcagatcgcctgggcttggagcccatttctgctgtttccaaagtgtgtgactctgggcagttacttcacctctttatggctcagtttcatgatctgcagattgcagatgatagtagcgcctgcctttggaaatataactgagttatattcagataataaccaagttatattcagacatgtaaaattcagataaaatgaaaagggtaggccgggcgcggtggcacatgcttgtaatcccagcactttgggaagccgaggcgggtggatcacgaggtcagaagattgagaccatcctggctaacacggtgaaaccccgtctctactaaaaatacaaaaaattagtcgggcgtggtggcgggcgcctatagtcccagctactcgggaggctgaggcaggagaatggtgtgaactcgggaggcggagcttgcagtgaggcaaaactgcgccactgcactccagcctgagtgacagagcgagactccaactcaagggaaaaaaaaaacaaaaacagaaaagggtttcctttaaaacattcagataggagagatacgtggggtagacatcaaacaagatcgggagaatatggcttatttttgaagctaagtgatgggtaagtacatggacagtcattccactattctcttaatttttgcatgtttgaacgttttcagaataaaaagtttttagatatgtaatgcatatataaaaatatgcacacatagcacttaaaacggtaccagatacatagtaagcactatctacacattttctgttattattaatattatttatgtgaggagaacaacagagagagggttccacccctaggagagctcacagtccccaagggagatggacattagacaaacacatgctccagtcaaagaaaaaggaccaatggggacagagtgggagagggaagtagagggtgttagcagctggtataacacatgaaaatcttgtctttgtggtcagaaaggctcccttcgtccagacctggaaggcaaagccacaacttgacctggggagtcaggggagggtttaaagcttcagagcccgtggtcatatttagaaagctctttaccactgccacgtggagggtggaccagagggagcaaaggtaggagctgggagggacccaggtgggagaggaccagctggaccaagggagggccatggggacggggaaaggagtgggtacaagagacactgaagagactgagtggactagctgtggtggctcacgcctgtaatgctcgcactttgggaggccaaggcaggaggatcacttgaagtcaggagttcgagagcagcctggccaatatggcaaaactccacctctaccaaaatacaaaaaattaaccgagtgtggtggcacgtgcctgtactcctagctactcgggaggctgagacaagagaattgcttcaacctgggatgctgaggttgcagtgagcttgaacccgagaggcagaggttgcactccagcctgggcaacagagcaagactatatctttaaaaaaaaaaaaaaaaagaggctcagtgggtcgggcatggtggctcatgccattaatcccagcactttgggtggccaaggggggacgatggcttgaggcctggagttcacgaccagcctgagcaacatagtgagacgcccccatctctatgtgtccacaggaaaattaaaaattcgctgggcttggtggtgcgcacctatagtcccaggtacttgggaggtgaggtgaaggattgcttgagccaaggaatttggggctgcagtgaactatgatggtaccactgcactccagtctgggtgacaagagtgagaccctgactctaaaagaaataaataagaggctaagtagacaggccgtggggctgatgagcagtgggaggggtgagaccccatattctgccccagatgactaggttcctacctcatagtaggcaccattgtggtagcagccacattgctggatgggcacgcaggcttggccgttgtagaggaagccggagtcacactggcagccctcagcacacccatctgggcactgcagaggggcactgagagccgagcagcccagggagcaggtgtccgcacagagctcgtagtgactgttctgagggcattccatggctgcaaggagggggtgccgatcagagccctggggagggaggggctgcaaggcccagggtctaccccttctgtgcctcaagctctcccctccctgcccctccggctctccctcactcacgacagaaagtttcattcctccagggctccacctggcctccagctgcctggcaagcactcacgtaggcatggatgttgctgcagagaatgctcaggttcccaccacccaggcagagatcaaagatgcaatctttcaagggaccctggggatccaccagcttgtggcaagaggacagtggccctgtggggctggagaggagcccacagaactcctccttctgatacttcttctccagctcgggaggacactcctcgctggggatacagccctcgctccccggcgggcaggtgggcggcggcaggcagggagagtcgggcaccacctcctcccaggagttgccgaactcattggcgttgcctgcctgcgagccattgggcttctggaagtcatccttggggtcgccgttgtagttcccacacaggccacacatcagctggtagtagtttccagggacggtgacccgcacatagtacacaaggtcgtaggccacacgcaggccgaagtcggtctcaatcacaacatctgaaccatgctgggaggcacggatctggccgttggccagcaccacgggcagcttcatgtccacaccgttcacctgggaggggaagagaggcaggccacgcttcagaaagtatactttgagtgagggtgggaccctagttcaagcccatgcctgatgctgatctttgtgacctcaccccttaggccctcagtttcctatttattaaatggatataataacagggcctgatagtagattgaatggtggtccccaaaagacatattcacccagaatcccatagcgtgagcttactcggaataaagttctttgcagatgtaatcagggtaataatctcaacatgagattatcctggattaaattgggccttaaatccaatgactagtatccttataagagccagaaagaaaaaggcaaagagacacacagaaaaggccacatgaagatgaaggcagggattagaatggtgttgtcacaagcccagagaacctggagtctgcagagctggaaagggaaaggaagatcccccaaccagtgtctttggagggggtgcagccctgcccacaccttgatgttgaacttctggcacccaggactgtggaacatacatttctagtgttttaagccaccaagctcgtggtaatttgttatggcagccatgggaaacgaatacaggtctcgatgaagtaacaagcctccagctatcctttgtttaccgcttgctgcagccattaataagcaatgatcgcccccggagccacttgccccagttcaaacagtttcccccttaccctctttgtgaccttgggcaagtgagtcacctctccctgtttctgtttcctcatctatcaagtgggaataaggcgtttgccccatggaactgttgtcaggatcacataaattagtatctgtaaagtgctgagaaacgtggctggcatagcatgcatgcttcaggagcatttgctgttattagcagctatgagtggaggtttttcttctgaagagtaaacagaaccacaggtttttgctttaaagcatcagcgagtggaaagttaggctaaattcttggggaaatgaacttaaacctatgagctgaggaccagtggtttcagttaaagatttactaggctccaacaaagcctggtaaatccacccctggacagggcacagtggctcatgtctataatcccagcactttgagaggccaaggcgggaagatcacttgagcccaggagttcaaggtcagcctaagcaatatatcgagatcctgtctctacaaaataaaaaagaaaacaaattaactgggcatggtggtgcatgcctgtactcccagccactcaggaggctgaagtggtaggattgcttgagagcaggagtttgaggctgcagtgagctaggatcacaccactgcactccagccttggtgatagagcgagaccctgtctctaaaaaataaataaatacatcaacccctgattaacatgctttcttacccttccttatcacagacagtgcacaccggattcttttggaaatgtgaagaatcagaggagaaggcaggagaaagacatgctcctggctgagtctcctaaaaagatggtcaactgccacacttcccaagcagggctgggcggtgggtaagggcaactgacttagccttgcctcagtttcctcagctgtaaactgcggggtaataagagctcccacatctgtagggaagctgggggtttcagtaagaagcaactaacaagaacatcaacaactcctgtgtatttaggcgctgtatgtcaggggctattctaggagcttgggaaacattagggaatatattcaattaagtcctgcatgtcggccgggcacagtggctcatgcctctattcccagcactttgggaggctgaggccggcagatcactgagctcaggagttggagaccagactggccaacatggtgaaacccgtccccactaaaaatacaaaaatttcctgggcatagtgttgcacacctgtaatcccagctactctggaggctgaggcaggagaatcacttgaaccagggaggcagaggttgcagtgagccgagatcgcgccactgcactccagcctgggtgacaaagccagactctgtgccaaaaaaaaaaaaaaaaagtcacgcctgtccagttcgccagattaagtcagtaattgatcagcaccttcgccaatactgccactagaaaaacagctgcgtgtctgtttcagtgggatctcaggggaaacccctccactgtaactcagatgccagtctccacatgagaccaaatcttctcagtaagaaaagcactgcagagcagcacggggttcaagctccacctttgctgggggactatgggccagtgatgggccatcccactctgaaaaataaagcaagtcatagtgcctgcagtccctgttgcaagcatacagacaccatggacgtgaagtgcctggcagccaaaaggtgtgcagtcagctgtatagaaactatagctgctgttgttgttgttaaggcggtgagagtgtcacccacagattgtcctctgtccatgaagcttctccaaactcggactttctcaacctctgatggcaccacgtcctgccaataagtggcagactagggaggtgagtagggcagaatccaggactgaggtggagagaggatggagtgggagggaggagagggtgggagaaatttggagagaaaagtcaatgcatggaggtaaagagagggtggagactgagggacagagatgggggagcagctcccaagtccctgatgacacctccctcattggcttcccactcggttctgactggcatcttctgtcctcagagaccccaggcctcgcacatgcactctcatctcttgtgcccccaactcctgggctgagcgctgcctgtgccccacctacccacaggcccctcgccccctgctccccatctgctctcaccgtgaccttccactgtctctgctccagccgcagggtgaagtttgccacctggaccgtgatcaccctggtcacactgactcgcccattaccccaggccacgttctcctgcaggacggcaaaccgatgtaggccaggccgggtgccgcaggtctgagccagcacatacacgcaggtgcccatgaagtcgaagcggcggccatcgaaggtggtgtagtggggatctcccgacgcctggcaggtggtagagcccacggccacgcagcccaagctgccaccggatggccggcaggtctcatgcgggccgcagctggagggctcacaggacacctcaccgccctcccggcagcggcaaagggaatcacacccagggccagggtagaaggtctggcccagtgggtagtagcggtcatcgtggaggcagccacactggcccacaggtacacacgtgtcaccactgagcacgaagccagcatcgcagacacagccttcacggcaggccgactcacagccctcgggtgccgacaggctcgggcagctcccaggacaggagtcaccgcagagctcgtagtggctgtgggcagggcactggaaggctgtggggacaaggtgggcatcagccaggtaggtgtttgagtcgcagtcttgggaggccctgagtgggaaaactgctcaggccaacttgggcgtctctgggtaggcacatgtgatccaggacatctaactgggggactcagcgtgggacctggaatgggaggggacatgcccaggtctctctgaccaaatatttctgaagatcaaatgactctgcttggctgatttttttttttttttttttttgagacaggctctcactctatctcacccaggctggagtgcagaggcgcaatcacagctcgctgcagcctccacctaaacctcaagcaatcctctggcctcagcctcccgattagctgggactacaggagtaagccaccacatctggctgatttattattattttgtgtagagatggggtctcactatgtaagccaggcttacctgggtgaaatggatcacttatatctattcggggtatgcaggatcagaactgactatgggcatctcagcgtgtgaatgtgactggggtgtggggccacatgtatctcagggtatggctctgcctgagggcacccagctgtgggtgtctgacatgcagcatctcccagagtccttctgacatggtctgcctaagggtgtgcctgggtgaagttggcaggatacctgtgaccaggagacctgcctgaagggaaccgcctaggactatctaaccatgcatctgtgtggatctgcccaaggctatgccaggatcctgtttctttctgagtgtatctgaccagtcagtataaaatttaagcagatatcactgaaggtatgcgactaattccatgtgactaggtgtatttcagtgtgtgcaacagacctgggccctctgaccagctgaaactcactaggtcttcctaacaaggggtactttgctatgtgacagaggcagggtcagccatcccaatctacatgccttggatacctgaaagcatggatcaccaatccctaagagtgtcctggaccccaggtttcttttctttctttttttttttctgttgtttgttgtttgtttgttttttgttttggagatggaatctctgtcacccaggctgaagggcagtggcacgatctcggctcactgcaacctctgcctcctgggttcaagtgattctcctgcctcagcctcctgagtagctgagattacaggtgcccgccaccacgcccggataatttttgtagttttagtagaggtggggtttcaccatgttggccgggctagtctcgacctcctgacctcaggtgatccgcccgcctcggcctcccaaattgctgggattacaggcgtgagccaccgcgcccacactctgactaggtgtttctaacggactctctctcactgcagtacctgacttggggcatttcagtgtgtcagtgccaaggtgtttcctgacagtagataccgagctcgggaaggaaggtggcccctcagcctcatggaggaggaaggggctgctgtcctacagtcctgggaagggcagggagagaccctactatgtggaccatgcatggagcagtactcacgacagaagtccggccgcctccactcgcggagctgggccccagcggcctgacaggctgccacgtaggtggccactgcaggacagaggcctccaggatggccctgaacttggcaggcgtccagcaagcagccctggaagtactgcgcgggcggcacaaggccgtggcagggcgccagcgggccgtcggtggcggagatcacgccgcaggcgtccgggccgccgaaggactcttgctgctctggggtgcacggcgacgggcatggcttggacacacattccccgcagccctgggcgccgcccacctgccatccggcgggcttcccgcccaccgccttcaggtcgtctgcggggtcctggttgtagttcccgcataagccacagagagagcccgcgtacgccgccggcacgcgcaggcgcacgaagctgtccccgtcgaaagccagcgagagccctgaggttgtggtcaccaccacgtcggcgccgctcaggtgtgcgtgcaggagcgagtccagctggaagggcagagtgacgaacacgccgtccacctgtgggcagtgggggagcggtgaacggagcaaacacgggtttgaatcctggccccactacctactagctgtgggacccagagcatgtcacctcccgctgaaaataataatgagcatctataggccgggcctggtggcaaagcctgcaatcccaggactttggaaggccgagatgggaggatcgcttgacgccagaagttcagatcagcctgggcaacatagtgagacccccatctctacaaaaaaatgaaaaattagccagcgtggtggcgtgtgcctttagtcacagatacttgggaggtggaggccaaggcgggaggatcgattcagcccacgagttccaggctgcagtgagccctaatcctgtcactgcactccagcctgggcaacagagtcaggctaagaaaagaaagaaagaaagaaagaaagaaaagcaagaaagaaaaaaagaaaagaaaaacaaagagcctctactggctcatgtcactgactccttatccttctcgaaaacaggtacttttcctagaccagtttacagaggaatacactaggctcacagaggaagaagctgctgtgccaagccgtcaggctcctaggcgtacactctgacccttccatcatgccccagctaagctgtgaaaggtgcccaggggaatggtgaagcccttaccatctcaggcaaccccagagctggcacttgctcctgtctggcccacagccctcctcacctgtagcttccggggccagcgggcactcagtgtcaggctgtggttgtagatttgcagggtgacactgcgggtgtagctgacagcctggctgccccggtgctcattggctacagtgacagtgaagttctcagcccccaagggtggtccgtggcagggtgcactcagcaggtactcgcaggtgccttggaaattgaatcggtgcccatccagagtgacgtaatgggggtcaccccacgcctggcactcagctgtgctgacgggctggcagccgtgctggccggatggcaggaggccacacacttcacccagcccacagctggcaggtgtgcagaccagcgagccacccccaggcccgcagcgacaccactgggagcaggtgccatcagcccaaaactcactgcccgcctcgtggtaggtgccattggcccagcagccgcagccgttgttgaggggaacacagcggtcagcacttaacacgaaacccgcgtcgcactggcagccctccacacaggggccctcacatacggctggcgtcgtaaggggtgcaggggacggacagctggccgggcagggtgagccacagacctcatagtggctgttttctgggcaggtgatctctgtgggcagatgaaggagcaggaaggagagaaacagaaagaagggtgttaggggtggggtcccagaacagggtgggaggagacagagagagacactagggagcagacagagaaagggggagacagaaaacaagacacagagagaggacacagagaaagaaatgggagaaagcgagacaccaggagacccaagcagaaactgagggagctagagaatgagaaacagacagatagagacaagcaaagcgaggcccagagacgagcaccaagaaacagagagacaaacagagaaaaaagaaaacaaagagacccagaaggaccagagtgaaaccaaaccagccccgaagagatgggaccccgcccccagccccgcctctgctcccccaacactcaccacagccaacctgtgcccgccagtcttcgatgacaaccccagcagcctggcaggcggccacataggaagccagagccttgcaaagaatgtcacggtccccaccacccatgcagacgtccagaacacagcccttgaagaagctctcaggtggcacatgagcatggcaggtggtgaaagggccccctgtgccgggggccaggggtccgcagaagccagggccctcgtactgctccaaccggtcctcagggcacgttgggcaggacccccgacattcgtcccaacacagtgggtcccagcctggggctcgccagctgccgccccagatgggtatggagggagccagtgtgccattagggaagacctggtcattgttggggttgcggtccatgttaccgcagagcccgcacactgcgccatgatagctgctgggcagcgtcacgtctacccgccagttccagtcatagctgacttgcagtccaaagtcagccaccagcagtgccttcgatgcaccctgggtcactgaaatccgcccgtcggccacagagacaggcaaggctgtgagcacaccgttcacctgggggaaggagggaaggcaaacgggtcactggaggttttacggccccagctctggccctctgcctccctctctctcatcccaccgggggctgggagaggccagggccttcccccgagagttggattgtcatctgacacactgtggacagttgttctagcccaggtcttggggaacgaaacctcactttactttttctagatcttctcccttcatctctatctccctcccctgtctctgtctctctctctgtgtctctctccccctgtcttcacctaaggctatgcctctgggtcttctctctctctgtctctgtctctctctctctctttctgtctctctgtctctgtctcacccttttcccttcctccctacctccctcattctttgtgcatctcttccactcactcaccatcatttattcagtgcctactctgctgcatcactcagtctctccatgtgagctgccatcaagctacatctccatttccttgggcagaaaggatagcccattcctctcccccatctccctatatttctttttcttgattactttttttatttttcagacggagtctcactatgtcaccgaggcttgtgtgcagtgttgcagtctcggctcttgtaacctctgcctcccaggttcaagcaattctcctgcctcagtgtcctgagtagctgagaattcaggagcatcaccacacccagctaatttttgtatttttagtagagacggaatttcaccatgttagccaggcttgtctcgaactcctgacctcagatgatccatcggcctcggtctcccagagtgctgggattacaggcgtgagccaccgcacctagcccgatctccctgtatttctctccatgtcctggtctctgggcctctcacttttccctcaccgacactcaaacgactgttcacctggactagactctgagctcagcatgtgacatgcacggccttgctgtgggggaggccctgatacgatgcccacttcacagatgaggaaactgaggcctaccaagtgaactgcccagcatcacatagctcataaggaggagaggctggattgaaacccaggtctataaaaaaggcaaatgctgaggtcctatgttaaagccctttgccaggggctaggctcatttaattcccagtaacagggtgacatttttgttgcaattattctctttgttgacagtttgtttcaggcccaggtgaagacaaagagccttgagctgctaactgtggtcgtcaggatccctcctgccctcccggggacctcaggggaccatcctgccacacatacccggactttgccgatctcgtccttgtggatggagatgttggtgccgagggcagccacggtgacgactctcacgtaggacacagcagggttgccccggttctggttcttggtggtgacggtgaagggtgtcaggccctgggtgctgacccccgggcagccagttgttgccagcacatagttacaggtgccctggaagtcaaacttccggccatcgaaggagtggtagtgtgggtcgccccacagccagcacgtggcctcatagttgggcaggcacacgccctggccaccctgctccttgcatgtctcctgtggccggcatgtcacgccgtggcacgggtctggggacagaagagggaggaggaccttgaggggctgcccattgtaaaggatggccgctccctccacatctaccccagtctgtgccagggatctgagggttactgcaggcaagaccacattccagagtcctcatgtctaggacccaggtcctatagtttgcttttttattttgttttgttttgttttattggttttttgagatggagtctttctctgtcacccaggctggagagcaatgatgcaatcttggctcactacaacctctgcctcccgggctcaagagattgtcctgactgagcctcctgagtagctggcattacaggtgcccaccagcatgcttggctgatttttgtatttttagtagagacagggtttcaccatgttgcccaggctggtcttgagctcctgacctcaagtgacctgcccacctcagcttcccagagtgctgggattacaggcctgagccactacgcccggcctgctattttcaagaccagcccctgggagtcctgcacatctgacactgaggcatcatggtggactgtgtctatgtctcgggtgtcaaagttcccatatctgagatcccggccccagaggtccctacagccaagacttaggccctagagtccccctgcctctgagactgaggccctgccatctgctgtgtgagactgaggtcctggagtccctgcacctaagacccagtctctggggtccccatgtttgagacactggtcctgcagatttctgtttttaagttacagtttccattgtgcccttgcttgagagttcagcctgttcttatattctaaagctttatagaaacctcaccgtcttcacttacataggctacggctgctttcacaccacagtggcagagtgagtagttgtgatccagaaggtatagcctgcaagcttaaacacttaccatctagccctttagagaaaaggtgcacttgaccccagttgagatctgtgccccaggggtccttgtgtctgcgatgccagccctgagagcatccatgtctgagatcccagccccagggttctctgtgttcaagacctgggccccaggccaggtgtggtggctcaggcctgtaatcccagcactttaagaggctgagacgggaggaccatttgagccctggagtttgagaccaggcctgggcaacatagcaagaccccatttctacaaataacttaataaatgagccaggcatggtggtgtgtgcctgtagtcccccactactcagaaggctgaggcgggagaattgtttgagcccaggagatggaggctgcagtgagctatgattgcatcactacactccagcctgggcgacagagtgagacttatctcaaaaaaaaaaaaaaaaaaaaaaagatctaggcctcagggccccccatgcctgagatctcagccccctggacatctccacatttgagagaaattggtctccaatttctccaggtcctggaggcctctatgcccaagactacggccctggggtgatctctggcaagagcccagtgccagggtctcagcaggatttcaaacgtttgagaccctaactagctaagtctcatggcctgggctccctcagtgcaagactccatccctgagggttgctgtgttcaagacagtagccttgagcgtgtctcactgctgaggccctgtcctggagggcttctgtgtccgagaccctgttcggacagttactacatctgtgaccccagcttgcggaaccgctgtgtgggagaggccagccttcaaacgtctccttcctcctgtgtccattatcaatgtaccgcctctcagcttcaaatatacccacggagttaagctttgtcaacagagggcgctggagagtcaccacaggagggaggggctactggtctggattccagccagtttggtccttccagctctggccagggtgcggggccacattcagcgagtgccactggccgcagctggcttcccagtgaggggttcccttcttgccaagtccagcctgcagaaacctctgtgccacccagtgggctacagctgcagtgagactggactcagccttggggctgattctcccctccttgaagaggaggggccaatgtctcccttccttgaggcctctaccttagccctagagtgggagctacttcttatgtttgctttggtggtattctttagtgctctctttaccgtttcttatttatgtttatttatttatttgtaaagagacaaggtcttgctgtcttgcccaggctggagagcagtggtgcaatcatagctcactgcagcctcgaaatcctggggtcaactgatcctcctacctcagcatcctaaatagctgggaccacaggcacgcatcaccacacctggctaattttcaattttttgtggagacaggggtctcactatgttgcccaggctggtctcaaactcctggcctcaagcgatcctcccaaagtgctgggtgtgtgagccacggcagcaggccctctttacccttaatagttaatctcctattaataagtaaatgtttaattaaactttcctcattcaaatggccatacgctttctgtctctcgactagatgctgagtgatataccccccattcctgggagtccccattatcctgctcatcagccctgagagtcttagcccccactccttggtgcgggagctcccattctcttatccttagggggaggagagttctctgctcttcaccctaagaaatgagccctgggggtggctgtgtcccagatttagtctcggggattcccacatcagagactatactcctagaaatcctgatcttccacttgagatgggtccccatatccaacatcctgccttggtggggtctctgtgcctgagactcagaactctgctctctgtccctgcccctgggatcccagtctctcccctgccctgtgctgctagtgtctgaaccccacaactaatcccacacatcagtgttctgctcacgatggccccctaggctgctgctcttgtattctaaagtcttataggagcctgacctcttcacttacatagtctacggctgctttcatgccacagtggcagagtgagtagctggaacgagaccatgcaccctgcgagcttaaacatttgccatgtagcacattagagcaaaggcgcgcctgggcctgccttatactgagggcctctgacagccaccctgagaaacttacctctgagggtccgcacagcctagattccccttaagggtccctgcctcccatagtaggtaaccctggccctatgaaacccagcccaggggtccctaggtctgtgacctcaatctttagtcctgtgcacctcccgccatggacaccccagttacaccaccctcagccccagagtccttgtcctccatccctagtcgcatcagccccaggcccaaccccagctcagcacctttggtgacgcagctcaggatgcctccggagggctggcacacctgccccggcttgcagctgtgttcctggcacaccatgcctttacccgcatggcacgtgcactgctgccgacagttgtcaatgaggactgtctgctccggctgtggggagagagggaacggccatcagggacaccacgggtgggagccgactctcacatctctggcgttctggcacagaggggtttggcagacatcacagacaagggacatctctcagcaggatggcccgttgtctgtgaagatgaggcacagcatggctttgaggccatgattcatttgtacatttgttcattcacttttcttcattaactcattcattccaaaatatccgctcaatgtctgctgtaggagaaatggtgtgacacagtaactaagggcagatcgcctgggcttgaagcccgtttctgctgtttccgaactgtgtgactctgggcaagttacctcacctcttgttggctcagtttcctgatttgcaaattgcagataatagtagcacctgcctatggaaatataaccaagttaataacacatgtgaagtgcagatgaaaggaaaagggtttcccttaaatcattcagataggagagatgagtggggtagacatgaaacaagattgggagaatgtggcttatttctgaagctaagtgatgggtaagtacatggacagtcattccactgttctcttgatttttgcatgtttgaacgttttcagaataaaaagtttttagatatgtaatgcatatataaaaatatgcacacatagcacttaaaacggtaccagatacatagtaagcactatctacacattttctgttattattattattattcatgtgaggagaacaacagagagagggttccaccccaggagagctcacagtccccaagggagatggacattggacaaacacatgctccagtcaaagaaaaaggaccaacggggacagagtgggagagggaagtagagggtgttagcagctggtataacacatgaaaatcttgtctttgtggtcagaaaggctcccttcgtccagacctggaaggcaaagccacaacttgacctggggagtcaggggagggtttaaagcttcagagcccgtggtcatatttagaaagatctttaccactgccacgtggagggtggaccagagggagcaaaggtaggagctgggagggacccaggtgggagaggaccagctggaccaagggagggccatggggacggggaaaggagtgggtacaagagacattgaagagactgagtggactagctgtggtggctcacgcctgtaatgctcacactttgggaggccaacgcaggaggatcacttgcagtcaggaatttgagagcagcctggccaatatggcaaaatcccatctctaacaaaactacaaaaattaaccatgtgtggtggcacatgcctgtagtcttagcttcttgggaggctggcgcaggagaattacttgaacctgggatgctgaggttgcagtgagcttgaacccaggcagtggaggttgcactccggcctgggcacagagcaagactatgtcatttaaaaaaaaaaaaaaaaaaaaagaggctcagtgggtcgggcctggtggctcatgccattaatcccagcccttggggaggccaaggtaggaggatggcttgaggcctggagttcaagaccagcctgagctacatagtgattcgcccccatctctatgtgtccacaggaaaattaaaaattcgctgggcttggtggtgcatgcctatagtcccagacacttgggaggtgaggtggaaggattgcttgagccaaggaattcggggctgcagtgagctatggtacccttgccctccagcctgggtgacggagtgagaccctgactctaaaagaaataaataagaggccaagtagacaggccgtggggctgatgagcagtgggaggggtgaggccccatattctgccccagatgactaggttcctacctcatagtagacaccattgtggtagcagccgcattgctggatgggcacgcaggcttggccattgtagaggaagccggagtcacactggcagccctcagcacacccatcctggcactgtggaggggcactgagagctgagcagcccagggagcaggtgtccgcacagagctcgtagtgactgttcggagggcactccatggctgcaaggagggggtgccgatcagagccctggggagggaggggctgcaaggcccagggtctaccccttctgtgcctcaagctctcccctccctgcccctccggctctccctcactcacgacagaaagtttcagtcctccagggctccacgtggcctccagccgcctggcaagcactcacgtaggcatggatgttgctgcagagaatgctcaggttcccaccacccaggcagagatcaaagatgcaatctttcaagggaccctggggatccaccagcttgtggcaggaggacagtggccctgtggggctggagaggagcccacagaactcctccttctgatacttcttctccagctcgggaggacacttgtggctggggatacagtcctcgctccccggcgggcaaggggtgggcggcaggcagggagagtcgggcaccacctcctcccaggagttgccgaactcattggcgttgcctgcctgtgagccattgggcttctggaagtcatccttggggtcgccgttgtagttcccacacaggccacacatctgctggtagtagtttccggggacggtgacccgcacatagtacacaaggtcgtaggccacacgcaggccgaagtcggtctcaatcacaacatctgaaccatgctgggaggcacggatctggccgttggccagcaccacgggcagcttcatgtccacaccgttcacctgggaggtgagagaggcaggccacgcttcagaaagtagactttgagtaggggtaggaccctagttcaagcccatgcctgatgctgaagatctgtgtgaccacacctcttagggcttcactttttgtatctctaaagttggtagaataatagggcctgatagtggattgaatggtggtccataaaagacatattcacccagaatcccataacgtgagcttacttggaataaagttctttgcagatgtaatcagggtaataatctcaacatgagattatcctggattaaactgggccctaaatccaatgacaagtgtccttataagagccagaaagaaaaaggcaaagagacacacagaaagggccacatgaagatgaaggcagggattagaatggtggtgtcacaagcccagagaacctggagtctgcagagctggaaagggaaaggaagatcccccaaccagtgtctttggaaggggtgcagccctgcccacaccttgatgttgaacttctggcacccaggactgtggaacatacatttctagtgttttaagccaccaagctcgtggtaatttgttatggcagccatgggaaacgaatacaggtctcgatgaagtaacaagcctccagctatcctttgtttaccacttgctgcagtcattaataagcaatgatcgcccccagagccacttgcccgagttcaaacagtttcccccttaccctctttgtgaccttgggggtcacaaagtcacctctccctgtttctgtttcctcatctatcaggcgggaataaggtgtttgccccacggaactgttgtcaggatcagataaattaatatttgtaaagtgctgagaaacgtggctggcatagcatgcatgcttcaggagcatttgctgttattagcagctatgagtggagttttttcttttgaagagtaaacagacaccacaggtttttgctttaaagcatcagcgagtggaaagttaggctaaattcttggggaaatgaacttaaacctatgagctgaggaccagtggtttcagtttaaggttaataggcaccaacaaagcctcctaaatccacccctgggctgggcacagtggcttatatctataatcccagcactttgagaggccaaggtgggaagatcacttgagcccaggagttcaaggtcagcctgagcaacatatggagatcctgtctctacaaagtaaaaaaaataaaaaaaaaaattggtcaggagcagtggttcacaactgtaattccagcactttgggaggccaaggtgggagggtttcttgagcccaggagttcgagaccagcctgggcaacatagcaagacccctctctataaaaaaaaaaaaattgtccggatgtggtggctcacgcctgtaatcccagcactttgagaggccgaagtgggtggatctcgaggtcaggagattgagaccatcctggccaacatggtgaaacccacgtctctactaaaaatgcaataaagtaactgggcatggtggcgggtgcttgtagctgaggcaggagaatcacttgaaccagggaggcagaggttgcagtgagttgagatcgcgccactgcactctagtctgggtgagaaagtgagactgtctctcaaaaaaaaaaaaaaaaaaaaaaagtcacgcctgtccagttcaccagattaagtcagtaattgatcagcaccttcgccaatactgctactagaaaaacagctgcgtgtctgtttcagtgggatctcaggggaaacccctccactataactgagatgccagtctccacatgagaccaaatcttctcagtgagcaaagcactgcagagcagcatggggttcaagctccacctttgctgggggactatgggccagtgatgggccgtcccactctgaaaaataaagcaagtcatagtgcctgcagcccctgttggaagcatacagacaccatggacgtgaagtgcctggcagccaaaaggtgtgcagtcagctgtatagaaactatagctgctgttgttgttgttaaggcggtgagagtgtcacccacagattgtcctctgtccatgaagcttctccagacttgatttttcccaacctctgatggtatcacatcctgccaatgagtggcagactagggaggtgggtagggcagaatccaggattgaggtgaggagaggatgaagcgggagggaggagagagtgggagagatttggagagaaaagtcaatgcggccaggtgcagtggctcacgcctgtaatcctagcgctttgggaggccaaggcgggtggatcacaaggtcaggcgttcaagaccagcctggccaacatggtgaaaccctgtctctactaaatagaaaaattagccaggtgttgtggtgggcgcctgtaatcccagctacttgggaggctgaggcaggagaatccactgaacccaggaagcggaggttgtagtgagcccagatcgcaccattgcgttgcagcctgggcgacagagccatactccatctcaaaaaaaaaaaaaaaagaaaaagaaaagtcaatgcatggaggtgaagagagggtgcagacttagggacagagatgggggagcagctcccaagtccctgatgacacctccctcattggcttcccactctgggttctgactggcatcttctgtcctcagggaccccaggcctcgcacatgcactctcatctctgtgcccccaactcctgggctgagcgcggcctgtgtcccacccacccacaggcccctggccccctgttccccatctgctctcaccgtgaccttccactgtctctgctccagccgcagggtgaagtttgccacctggaccgtgatcaccctggtcacactgactcgcccattaccccaggccacgttctcctgcaggacggcaaaccgatgcaggccaggccgggtgccgcaggtctgagccagcacatacacgcaggtgcccatgaagtcgaagcggcggccatcgaaggtggtgtagtgggggtctcctgacgcctggcaggtgctagagcccacggccacacagcccaagctgccaccggatggctggcaggcctcgtgcggtccgcagctggaggactcacaggacaccaggccgccctcctggcagtggcaaagggaatcacatccggggccagggtagaaggtctggcctggtgggtggtaggtgccctggtgtacgcagccacaggaggccaggggcaggcaggactcaccactgagcgcaaagccctcatcgcacacgcagccctcatggcattctgagccacagcccccgggcactgggaggtctccacaggacagcgggcagccgtaggaacacgcctcatagtggctgtggggtgggcagctcagtgctgcagggagaggagacatcaagatcaagaattcctgctcccaggtcaggagttcgagacacactcacatacaagtggtccctcaacacattcgtatgcacacaaacactcaaacacactcacacacaagtggtcccccaagacattcatatgcacacacacgctcaaacacactcacacacacacaagcggtcccccaacacattcgtatgcacacacagatgctcaaagacactcacacacaagcggtcccattgcagggtgcttggggaacacattacatcgcagttaatctgatcctgataattaagattctttcccaatttaactatggtttggagttatctattatggttttttttttttttgagataggggtcgctctgttactcaggctggagcgcggtggtgcttgctatcacagctcactgcagctttgacctcctgggctcaagcaatcctcccacttcagcctcctgagtagctgggactataggcgtgcaccatcatgcctggctaactgttcaaattttttatagagatgcggtctcgctatgttgcccaggctggcctcaaactcctgggctcaagcagtccacctgcctcagcctcccgaagtgccgggattgcaggaatgagccaccacacccagccttctattatgtctttaatgaccttattcaagttggatacatggtgttgatatgtggcatatattttaaacatgcatatgcatatatttctgtgtttgtataatctatgcaatatttgtgaatgcaatacttttagcttcttccttctatagcagtaattaaaatatttagccagtgttataaagaaaaaaagaaaaacctccctgctcccctccccaaactccagtcactccataaaaagcaaatctaagtgactaaaactaaaccacattaaatctctatctgtgctgtcaaatacagtagccactagccacttgtgaccatttggatgtaagttaattaaaatgaaacaaaattgaagatttagctcctcagtcacaacagcctcattgcaagtgctcagcagccacatgtgacctgtggtgacctggtatgtatttgaacagctcaaatatggagctgtcatcattgaagttctgctgggtggtgctgttctgaagctgacatccagcttacaggagaatcatggggacatagggacaagttcaataacactccaaaatagcaactagccagatcctgaaagtatgaaattctgcaggataaataacctatctttcccagtaaataagtgacatagacaaaaggaagagctggatggagggatagctatgtgataaggcaaatgaatgaattagaattagagtgaagaggccgggcgcggtggctcacacctgtaaccccagcatttttggaagccgaggcaggaggatcacttgaggtcaggagttcgagaccagcctagccaacatggtaaaacccgtttctactaaaaatacaaaaattagctgggcatgatggcgcacatctgtaatcccagctacgtgggaggctgaggtgggagaatcgcttgaacccgggaggcggaggttgcagtgagctgagattgcaccactgcactccagattaggcaacagagtgagactccatctcaaaaaaaaaaaaaaagaaagaaagaaagaaagaaaaaagaaaagaaaaagaattagagtgtagagtccaggtggtaggtttatgggtcttcactgtaaaattctttcaacttttttgtatatttgacaattttcataatactatgttgggaggaacaaaggaaggaaattctgacagagtaaaagcaaagaggtagatcaatccaatgcagtatgtgtatttggtttggttctagagccaaacaaaatagaaaaaaacctttttttttttttagacaattgggaaaatttgaacccagattgggctttacatgatgttagggaattaatgttattgttgttactggtaattaccacatgccctcatatctctttctttcttccttcctttttttttttttttttttagagacagggcctcactggagtgcagtggcacagtctcgcctcactgccacctccacctcctgggctgaagatattctcccaccttagcctcctgagtagctgaaatgataggcactagtcaccatgcccggcttattctttatttttatttttgtagagactgggttttgctatgttgctcaggctggtcttgaactcctggcctccagcgatccttccacctaggcctcccaaagtgctgggattacaggcatgaaaagcaaactcctgtgccttaaaagtccttttttgttgctgaaaagcagatgcttactgaagtagttagaggagaactgatctgcctagaatttgatctaaaatattctaccaaaaaagagggggtggagtgagaggtagaggaactaagaatggcaaaataccaataattgttcaagctgggtcaggcctccgtctgcatatctaagacctcatgatccagtcttctagaacttccaggtggtacaaggaaaggagtagttttaaggaaacaagagattctcaatttccacacaggccacagagtctgataattaacagcacaaaatcaggagccagcctgttcaaatcaccccaccggctgtgtgacctcaggctagttccttaacatctctgtggttcagtttcctcgtcttgtaaaataggaataagagcaattctgcctcacggggtggttgtgaggattcaatgagaaacccttagaacaggacctgcccagtgggatgcgtgtcacacaactgctagctggaattatacgtgtcctgcctaaaaggacagcccaagaatgctctgttagaagagcattcccacttcccattgtccacctgtccccttcacaagtgtgcttcctgcactttacagaagagaacagtgcagtcccccacccatcctgaatctttttttttttttttttgagacagggtctcgatctgtgggccaggctggagtgcagtggtgcgatctcggctcactgcaatctctgcctcccaggtttaagctaagattctcctgcctcaacctcccaagtagctgggattacaggcgctcaccaccaggcctagctaacttttgtattttttgtagagacagggttttgccatattggccaggctggtctcgaactcctcacctcaagtgatctgcccgcctcagcctcccaaagtgctgggattacaggcatgagccaccacacccagccccatcctgaatcttaacacatggcacagtgccctggagtgtgaaacctctgaggacataaacggacgatttcaaatattgctatcgctgtgaacacaacgaatgctgaatcattattgagtaataaatcaaaaggagggcctaatagaattggctgctcacagataatataaaataaatttgtcgtgtctcactgtgtgccttccctatgactcagaaggggttcagagcacggagtgatgttactccacctgcactctgtccactcccacccacttattaatatcatgtaagccaggagctgtggctcaagtctgtaatctcagcactttgggaggccaaggcgggaggaaggcttgagcccaggagtttgagaccagcctggacaacatagcgagatcttgtgtctacaaaaaataaaaaattagccaggcatggtagtgtgcacctgtagtcccagctactcaggaggctgacacaggaggactactcgagcccaaagatggaggctacagtaagctgtgatcacaccactggactccagcctcggtgacaggataataccttatctcaaaaataaataaatatcatatctacaaaaatgaaagataggattagaattgatgctgaaccctgtctcattctaacaatatatgtgaaatattgggtgggggtaagctcactgagtgatgccattacaatggccattacaatttacttctgtttaatatttttatcaattgtgcacaaacaattcttgcaatgatatcttactccattaaaaaaaccacttagagtcttagagtctcaggaatttctaaaacttcttatatcttttataagaaggctgttttgtcctgggaggtttcacaccccagggcaacatgccacgtgttgagatttgggatgagtggagactgcactgttattattttattttattttattttattttattttattttttgagacagaatctcgctctgttgcccaggctggagtgcagtggcttgatctcggctcgctgcaacctctgcctcctgggttcaagcgattcttctgcctcagcctcccgagtagctgggattataaaaattctgaaatcttagtcatagatgtgtatgtttgtggcagagaagtgtgatggcgattgtgacacaggctgccaatggtcacgtcttgactctgggcatgaccatggcacttgctttggccaatgggacattggccaccatgataccaagtagagccttggaaagtgcttgcacactggggcttgtgtgctcttaggaatcttgagagcaccttgggaagaagccttggctcacctgctggaagatgagaccaagtagagcagagacaagaattcccagctgagggccccccaaaccaaccagcttgacaactgccagatgtgtaaaatcaccctagattacccggccttggctgagcctccaacagactgcagagatcaaccaagctggcccaggctgggagaacagctcagcagcccccagaatcatgagaaagaataaatacttggccgggcatggtggctcacacctgtaatcccagcactttgggaggctgaggcgggcagatcacctgaagtcaggagatcgagaccagcctggctaacatggtgaaacccccatctcttctaaaaatacaaagaattagccgggcatggtggcacatgcctgtaattccagctacttgggaagctgagacagaagaatcacttgaacccaggaggcggaggttgcaatgagccgagatcacaccattgcactccagcctgggcaacagagcgagactccatgtcaataaataaataaataaataaataaataaataaaaataaacacttgttttaatgcactcagccactaagccttgggttgtttgttaggcaccaaaagccagctgatacagtgactttaacaaaagacttccatgcattcaaatgtgttacattaggttaaattctgttagaactaaaaagcattagaaaatcagttcagaaaggcaaggatttgttttcttattctctcccctattgtatccggagtgtttagaatagtgcctggaatacagaaggtatttttgaatgttttggatatttgttgaatgaatgaatgtaagttgaaggagaaaaaggaatgatgtatttatcctgtatttttcagtggacaatgatgtgtaccactgtgtgctatgtatctgttgaatacatttaaaagaggagcataagtcaagtaatggtttcattttgaaataccaatattatgttgataattgtggaaactaaatgatggatatatgctggctcactatcctagtttactttggatatgtttaaatttttccctaataaaaatgttcttaaggccatgagcagtggctcacgcctgtaattctagcactttgggagaccgagttgggcggatcacttgaggtcaggagttcgaaaccagcctggccaacatggtgaaaccccctctctactaaaaataccaaaaaaattagccaagcatggtggcgggcgtctgtagtcccagctacttgggaggctgaggcaggagaattgcttgaacccaggaggcggaggttgcagtgagctgagatcgtgccactgcactccagcctgggtgacagagtgagactccatctcaaaaaaaaaaaaaaaaaaaggttcttaaaagtcaaaagttaccatttgttagaaattataagttttatgattatttcaggtgaaaaactagacatgtatgcttctattaattccaaaattcaaaaactttagaagtcagaatagtggttacctcttggggttgggaacctggattttttttttttcttgaatttgggacagttcacacaggtttgttctcttggtgaaaactgatcaagctgttagcttatgatatgtacatatttttaaatatctgtattatatttcaataataaattttttaaattaaaaatcgggtgagaggaaactggtacgatggctcacacctgtcatcctagtattttgagaggccgaggcaggaggattgcttgagcccaagagcccgagaccagcctgggcaaaatatcaaaaccctgtctctataaaaaatattttaaaaattagcgggggatggtggtgcaagcctgccgtttcagctactcaggaggctgaggcaggagaatcgcttgagcccaggagttccaggctgcagtaagctatgattgcaccactacactccagcctaggcaacagagcaagaccccatcttaaaaaaaatcaggtgagaggatgcatggcttttcaaacttctttcataggcaagcaaaggtgttggaaaaccattcatgcacccacctctgaaacaaggctctcaaactgactgcccaaggggtcaggcagatgtaaataagcgaggtaggatagatggggaccaaaaagaaccagagaggggatgagactcctaatgacaatactgttgctcatatctcaatgacagctgttatgtgggaatcagaccctgggccaccaggtgtactcagtcattttacaaataccaactgccgctgggcacggtggctcacgcctgtaatcccagcactttggaaggctgaggtgggcggatcacgtggtcaggagatcgagaccatcctggccaacatggtgaaaccccatctctactaaaaatacaaaaattagctgggcttggtggcgcatgcctgtaatcccagctactctggaggctgaggcaggagaatagcttgaaccagactcagaggttgcagtgagccgagatcatgccactgcactccagcctggtgacagagcaagactccatctaaaaaaaaaataccaactgcatgcccaccatctgtgattttctagctatcatgatcccaggtgtgtaactgaacctttctgaacttcaatttcttcatctgttaaatgggtataaccacaatccctacctcatagggctattataaggattaaatgaattaatgatatttatacattaatgaatatatataaggctgagtcccccagttgccacttccgatactcacggcaaagttcttcactcctccaggggtgcactgtggctccagcagcctggcatgcagcagcataggtggccagtgcgtcacacagtggcccagactggcctggcagcaggcagcggtcatagacacagtcgcgcacggcaccctgggggtccagcttgctatggcactcccggaagggccccttggggtcggcaaggattccacactcattcttgctctgcagctgctgggccaccagggagtccagcttgggacagtcacccggttcagttgctccacagccgggcctcgtctcttcttgccagctgttcccaaaggccagtgcattggcagcttgacccccaccccgcagagccaggtcatcagctgggtccccgttgaagttcccacagagtccacacagggcctcagcatagctgctgggcaccttggcagtcactcgtgcattccagtcataagtgacagtcaggccaaagtccgtgcgcacgacggcatccctgccctgtcggaacacctgcacctgcccatctgctgcttggaagggcagatactgaaggacgtcatccacctgggtggagatgcaagagggccacctggtcagggtattcacagttctgtggcccacccttcaattcactcacctccagctaccctgacctccttgctattctcttggacatattacgctcagtcccacctcgaggcctttgcacttgctgttccctctgcctggctcaccattcacccctcttcattcctaaagcaccagcttaaatccaaatccctcacccatggccttcaaaacctacatgatctgtctatctccccattacctccctcgcctcacctcttctcactgtccctctcactcaggctgctgcaaccatactagctttcttttctttttttttttggacagggtctcactctgttgcccaggctggagtgcagtggcacaatcttggctcactacaacctctgcctcctgggttcaagcgattctctctcagcctccctagtagctgggattacaggtgtgagccactgcacctggctaatttttttttctatttttagtagagagggggtttcaccatgttggccaggatggtctcaaacctcagatgatccactcgcctcagcctcccaaaatgctgggattacaggcgtgagccacggtgcccagccactagcttcctttttaaaatagagacaggggtctcactctgtcacccaggccagaatggagtggcacgatcatagctcacttcctagcacttcaggaagctgaggcgggagggtcacttgagcccaggagttggagaccggcctgggcaacttagtgcgactccgttctgcacaaaaaggaaaaaggaaaacgaaaaaaataaaatcttctaacaggcctcccccaccctcaggcccatccagaactccaagtcttcagagggtatttcctgctccgtcacccagccctgggcgccacgtcgctcaccagcacttgcccggggtactcccggcgcacggccaccttcaccccgcgggcctccacccgcacggcgcgcgtgtagctcacagtctggctgccccgatgctcgttttccaccagcacccggaaggcaggcagcgctgcgttctggccgcatgagccgaccagcaggtacgtgcaggtgcccatgaagtcgaagcgccggccgtcgaagctcacatagtgtgggtccccggacccctggcaggtcccgaagcgatcggggtagcagcccaggaggccgttctggacgctgcagcgctcacccgccgggcagctctgcttgtcgcggcaggtgacctgatgggtggcgccgttgcaggtgcagcgcctttggcacaactcgtccgcccacacttcctggcccggagcgagctggagaccctggaaggtgcagccacacgacgaggccggcacgcaggcgccgccgctggccacgaagcctgggaggcacacgcagccctccacgcaggggcgcccggagcagttggacggcgccgcagccccgttgcaggaggtcgggcaagcagggccgcagagctcatagcggctgttggcagggcaggacagggctgcggggagatcagagagggtggatcaggcccgcgtagcaggggccgtcgaagagcgccctgtcggggacggcgcccaggaattccatccccaaaccctgctcctctctcagagctcgccatctcagataatggcactgccattcttctgggtgctcctgcgccacaccccagcgacgcagttaatctccaccccgccaaccccctaacgctcactggacaaccaatctgtcagcaagtcctgtgagctccatattcaaaatctacccagattggccgggagtggtggcgcaggcctgtaatccgagctactcaagaggctgaggcaggagaatcgcttgaacccggaaggcggaggttgcagtgagctgagaccacactactgcactccagcccgggcgcagagcaagactttgtctcaaaaaaaaaaaaaaaaatccacccagttacagaatctgcctctgatcctatccaccgcagcagcctcctgcctgggctccctcctgcccccacagcctgttcctcacaccaggccgaggaatctgggaacatctgggtcagatcaggtccctccccatctcagagcactactgtggcttcctctcactcagggtaaacgccagagtcctccccatgcctcaggaggccctgtgccatctgttcctctcacctctcagccctcacctcttctccctctccctcgggctcactctgccccagccccagctgcctcctcctcccgggtcctcaccctcccacctcagggcctttgcattggctgttccctctgccttccctttccccagaaagcccactggggcccaggtggcctgggttcagatcccagatctctccttctcggccactgactccaatctccccgtgcctcagtttccccatcagtaagatgggataatgtagtcgagacctcacagggttgttgtgaggattaaatgagttgatctatggggaaacattctgtggacatcactgttagttagtacttagctgactccattgcctgaccctggtctcagctccaatgttacctgcccagaaaggccttccctgatcaccctcttcacgagcctcacagtcactgtcattgaatgaacttgtttctttgcctctctgaagatacttcctagttcatctgctcactgtctgtgtccctcccctgccgctaagagagaagttctgcgggagtggggacctgatctgtctcaatcactgctgagtccccagcaccaaggacagggcctggtacgcagcaggtgctcaggaaatactgcagaagtgaaagggagaataaatgaactctctgattcctattttgcgccaggcatggggttgggggggtgcttactgggcagtggggacacagaactggccaagacaaacacctagtggcctctatgtctgccctgtacttactccccctccctctgggcctgggcctggatgcctcttcctccctcctacctgtcctttctgcctctgggacatgtctctaggagcctcactcacaagggcaggaatagatttatgctggtcttcactgtgtcttcaatatcattagcatgcacagggggcaggcaggggttcaaggaatgcttgtggaatgaatgagtgaacgattaagcagacggacacctggctaaagagcctggactttatctagagggcaatgggagtcatgggagggctataggcaaaggaagagacgtcacgtctctgtgttgggattctgcagacaagaattcccgtcctgccaagcctttgagcatgctgttctctgggcctgcaactcacttcctcctctttctcttggcaacttccagcccctcttatgggtttcaaattggacatctttctctagaaaaccctccctgaccacccctgctccccaggctgggccaggaacctcctctggtttcccatagccccactgacttcctccatcctggccccaacccctctgcctgtgtcccccgcaatcccagccctgactcatctgcctgtctctctcccatcctggccccaacccatccgagtgggcctccccatcctgcctggacccctccagactgtcaatgtctagtgaaacgtctctccaaccttaggctcattgtggacagagctggctgtcttggccatcactaggcccctggcattgcccagcaccaggctgaaccataataacttctcagatattaagcagatgctagggatctcctgcccctcactgtatgctcccagcccccacccagggcatcactcacggcagttggctggtgatctccagtccccaaccgagatgccaagctccagacaggcctgggcataggcgctgaggccacggcacaggctgagccgctccccaccgaccacacacaggtcatatacacactgctccaggaagggcctggggtccagggtgtcatggcagacagcgaaggggccatcgagcttggtcagcatgccacagagtcggtcgccctcatagtgttgggcctggcctggggtgcaggcgggacagttgttctggcagccatcctcacacaggtagtccccatcatccagcttccagctacttgcgaactccacagcgtcaggagccagagccccgtcaggcgtgaggaagtcgtctgctgggtcaccattatagttgccacacagcccgcacacctggtcttggaagcgtgcaggcaggctgagtgccagctggcagtcccagtcataagtgaccaccagcccaaagaccagctccaccacggcccgtggtccgctctggtacacacgcaggcgaccctcactcagggagactggcaggcgcgagcgctggttgtcaacctgcagagtgggtgaagaggaggtggtcaggcccctgtgccatctggcctccagccctcattaaagtactttttaattaaaagttttaaataggagaatatagaaaaagagtatgtgctcaaacgtcactgactcaagccttccctgactgccctattttatgattttattttatggtttgtttgttttgttttgttttatagagatgaggtcttgctatgttgcccaggctgatctcaactcctggcctcaagcaatcctcctgcctcagcctcccaaagtgctagaattacaggcatgacccatgggacccagcctacacccctttttaaatggcagccttgggccgggcgcagtgactcacacctgtaatcccagcactttggaaggctgaggcgggtggatcactttatgtcaggagtttgagaccagcctggtcaacatggtgaaaccctgtctctactaaaaataaaaaaattagctgggtgtggtggggcacgcctgtaatcccagctactcagttggctggggcaggagaattgctttaacccaggaggtggaggctgcagtgagccaagatcgtgccaaacagagtgagactctgtctaaaaaaaaaaaaaaggcagcctctccctattccatagcctccttccctgctttccttttttttctatagcatctggccttctgaaatataattcacaaattgaccatgtttatcatctgtcttactccatcagaatggcagctccacaaagacaagggtttgggtctgctttgatcactgctttatccccagtgcatagaacagggcctggtagaatcccaggcactcactaagtgaattaagtcactgctgcatttaataaacattcactgggcactcactctgtgcctggccttgagctgggagatcctgggaatacgaaggtggcggagacagccccaagccctaccctcatggggctcccagtccattgggagaaacagacacatcaccagacagtgagagctcagaggggtcagggcagagatgggagaagcacaggcagaaaagtcaaggccaggatcagaaaggcccaggcagaggggtcaaggatgggataggggaggtacaggctgagggttcagagctgggatagtggggagataggaggctgtgaaaacctagaaaaatggccagatctaaccttgctggtcagggatgttgaaatcttaacacccaacatgatggtattaagagtggggggaggcctttgggaggtgattaggtcatgagggtggcaccctcatgaatgggattagtgcccttatgacagaggcctcagagagctctcagatccgctttccaccgtgtgaggatacaaggagaagtaggccatctgcaacctggaagagcaccctcacctgaacctggcagtgctggtgacctcatcttggacttccagcctccagaacacagagacgaggttgtgttgtttataagcctcccaggctctggagaagcctgaagtctgactaagaaccaggagataagaactatgtctctctgtgccctggggcatcttttttttgagatggaatcttgctctgtcaccaaggctgggctgcattggcacgatctcggttcactgcaacctctgtctcccaggttcaagtgattctcccacctgggattacaggtgcctgctaccacgtccagctaatttttgtatttttagtagagatagggtttcaccatgttggccagactggtcttgaactcctgacctcaagtgatctgcccacccctgctcagcctcccaaagtgctgggattacaggcatgagccaccgtacccagccttttttttttttaattaataaaaaaattttttaaattagatatgggggtctcactatgttgtccaggctggtctggagctcatggctcaagcaatcctcccacctcggcctcccaaagtgctgggattataggtgtgagccaccgcacccagcctgggcatctctttcttactctttccttacacattctctgagctgtgccagagctgagacttgaagtggagaagtcttagccaagaggatggaatatgataaaaggagcaacaggagagaggacagcatgagcaatggcccagaaggaagacagagcattcactcattccggctcccagcaaagcttctgtgagtcccactgtgtggcctgctctgtgccagctggtgctttagacactgcagtgatggagacaggccatggccccatgctcagagctctcagtccagcatggctgctcaaatctgtttctcccctaagtccagtgatctccattttaatttttctatttttttatttatgtatttttttgagacagttttgctctgtcacccagcctggagtgtagtggcagcatcatagctcactgcagcctcgacctcctgggctcaagccatcttcctgcctcagcctcccaagtagctgggaccataggcaggcgccaccacacccagctattttttttttttttttttggtagagatagggtctccctatgttgcccaggctggtctcaaatttctgggctcaagtaatcttccagcttcagcctcccaaagtactgggatcacaggcgtaagctaccatgcccagccaatctccatttttaaatgacacaaataatattcgttcattacagaaaactgaaaatgcacaggagcaaaaatgagaaaagaaaatcaccctgtaggcagacacatacaaatgtatagatcctgttgagttttttcctacctttagatatatttacacttaaaaaaaaaaagaccatgctgaagtcactatttcattaactcctctcctaacaatgtcttgtgagtatcctactatgattctgacagtagctctgcacctttgtcaagtcactgacctctgtgaggatctgacggaaaaaaaaatgaaaggccgggtgcggtggctcatgcctgtaatcccaacactttgggaagccgagttgggcggatcacaaggtcaggagatcaagaccatcctggctaacacaatgaaaccccagctctactaaaaatacaaaaaattagccgggcgtggtggcatgtgcctgtagtcccagctactcgggaagctgaggcaggagaatcgtttgaacccaggaggcggaggttgcagtgagccgagatcacgtcactgtactccagcctgggcaacagagcgagactccgtctcaaaaaaaataaaaagtagttttcagagagaggtataaaattctgtatataatttcaagggatctgaagtccgcctgaacttgtgctcaacccctccagggctgaagaacacctcctttcaccaactgattattaatcgcagagatctacctgcacactcacaaaatcagggaggtacaagaatatttatttcaggtcagatacaggggcttacgcctctaatcccagaactttgggaggccaaggtgggaggatcacttgagaccaggagttcgagactagcctgggcaacatagcaagaccttatctctactaaaaataaaaatacttagcccagtatagtggcatgagactgtagtcccagctacttggaaggccaaggctggaggattgcttgagcccaggagtttgaggttgaagtgagctataatcacaccactgcacttcagcctgggcaacagggcaagaccttgtctcaaaaaaaaaaaaatcaaaaaaatattcattgcagtattgtttgtaatagtgaacaatgtgtccatccacaggggactggttgaatgaaccatggtgttcatatccatataaagaattgtgcagatgttaaaaaaaaatagaggctgatagagaaactgttgatagagaaactgtttcagaatgtattgctaaatgcaaaaagcaaagtagagaacacaacatatatatacacatatacatgtatatatgtgtgtgtatatatgtatatatatatatatacacatatatactctctctctctatatatatatatattttatttatttatttttttttttgagacagagtcttactctgtcacccaggctggagtgcagtggtgcaatcttggctcactacaacctctgcctcctaggttcaagcgattctcctgcctcagcctcccgtgtagctggaattacaggcatgcgccaccacgcccagctaatttttgtactcttactaaagatggggtttcaccatgttgaccaggctggtctctaactcctgacctcaagtgatccacccacctaggcctcccaaagtgctgggattataggcatgagccactgcgcctggccctgaagttattgaacaggcaaaactaatctatgctggaaaaaaaaaatcagaattgtgatcatctccaggagtaggttggggactgtttggtaaggcacatgagggaattttcccaggtgataaaaatattctgtatcttaatgggcaatttggttacacatttgccaaaggtgaactatacagttaagatttgtgatttttgttatatataaatttcacctccaaaatcagccaaaagaagtgtgaaaatattatattctagttaatgacatggtgaagtcttttgggtgatatgtactcatgtctggaactttgaagtgcataaaaaataagagagattgtggaatggacagagggatgaaccgatggatcagtgtgtgatcaatcaagaagagtacagtgtttagaatctagatgattggcacctgtaatctcagcactttgggaggctgaggcaggccgatcagttgaggccaggagttccagaccagcctggccaacatggtgaaacccctctctacaaaaatacaaaaattagctgggcatggcggcacatgcctgtcatcccagctactcgggaggctgaggcaggagaatcgcttgaacctgatcctgccgctgcactccatcctgggtgacacagcaagactctatctcaaaaaaaaaaaaaaaaaagaaagaaagaaagaaagaaaactctaggcgattggcatatgagcattcactgtataagaatttcaactttggacattttaatattttcataataacatggcgagaaaaaggaagtaattgctctaggctgctgttattcatatgaactgaatagaaatgcatttaccagagtcaggacagctgagggattaagaacaaggactccagagccagcatgcctgtgcccttagctccacctcttactagctctgagccctggggaagtcactagcctatctcaacctcagtttcccaatctgaacatgttcataataataatgcctcctgcactgagtttgtgagcattaaattcgttaagatgagaaaagtgctaagaaacatatctggtgcatagcaggtgctcattaaatttagttatttggtcaacgtaaatcccccattgctggataattttttgtttgtttgtttttgttttatgctattataaaccatgttggcatgttaccccccagtctctgtctctgaatatcctttaaatttctagacgtgggatggctggagggcagggttctaaggtcctgctactgattttcaaatccgcctccccaccctccaactccatggcccacttccctgcaccctggtttgaggtcggccattgggctttgcctccgccttcggacccgcagctcatggatgttaaccccccaaagcccccaggtactcaccaggacgaagccaacttcaccgcgggtcagcgacacagagtggctgtaggcgcgcacagtgacgaggcccacgtaggagacgcggcggctgccccggtgctcgttcttggcctccacgctgaaggcgggcagggtgtcgtcctcgctgcacagctccaccatcgtgtacgaacaggtgcccatcatgtcgtagcgacggccgtcgaaggtggtgtaatgggggtcgccctgggcgcggcagacagcggtggactccgccacacacccggccttcccgcctaccacctggcagcgctgcccggctgcgcactgcatgccttcgcaggagggctccactggggacagtacagctggggagggaagggaacggtgaaaagagagaatcagaagtgtccgcggggttgtaatcccagcacattgggaggccaaggtgaggggggcggatcacttgaggtcaggagttcgagaccagcctgcccaacatagtgaaaccccatctccattaaaaacacaaaaattagcagagcatggtggcacatgcctgtaatcccagctacttgggaggctgaggcaggagagtctcttgaccccaggaggcgaaggttgcagtgagctgagatggcaccactgcactccagcctgggtgacaaagtgagactctgtctcacaaagaaaaaaagaagaaagaagaggaagaagaagaagaaagaagaaagaagaagaagaagaagaagaagaagaagaagaagaagaagagggaagggggaggaggaggaagaggaggaggaggaggagggaagaagaaggaagaaggaagaaaccgcctcaggcctcagagggaggcatcctggagcccaccttgccggggaagcttgagcaattcgctcacaactgcccatttttgcccatttttgcccattttaaaggtggggaaaccgaggtctggaaccccacagggagagagttgctcaggcctctctgagagccccatgttttctgattctccagtttaacacagggcagcctagaagaagggaaggcagtaaataagaaaaggcagaaacggtcattaaaatgttaatttgtgtttttctctcccccttttcccctcttccctaccttccctccagggtcaaaaagagctaagggatttttttaaggacagaaaatggaagacagccttcagcaggatgaaaaggactatggagtcaggccgcctaggtaggaatcctggctcaaccaactggctctgagacactgggcaagtggttttaaactccctctgcctcagtttcctcatttgtaacatgggggtgataataatacctccttcgtagggatcttggtggggggtgttaggattaaataagctaaaactcgagaaagctttagaactgaacctacgtgttaagtggagtgttacccattataattaatcacccaccgctccctcattctatttctcaagcccaaagtggctccttgaagttgggtggcttccatgccttggaggggaggggaggggcatttttgccaggtccaggaatgccagagtcttagcgtggcagggactacatgggaagaaacagctttcctccatctgcctcccagtcctcaaaagtttttgcagctgggtgtggtggctcaggcctgtaattccagccctttgagaggctgaggcaggaggatcgcttgagcccaggaatttgagaccagcctgggcaacatggaaagaccctatctctacaaaatataaattaaaaattagctgggtgtggtggtgcatgcctatagtctcagctacttgggaggctgagggaggattgctttagtccaagagttcgaggctacggtgagctgtgatcacaccaccgcactccagcccgagtgacagagtgacaccctgtctctaaaacaaagttttgagggagaaacagttatccccattttacagatgtggaaactgaagcccagagagatgaagtcacttgtccaagatcacacagcagagctgggatttgaaccctgggaccctgcactacactgacagcgtctcatgggctgagcctgaggtcacacaaactgccaggtcatatacattaactgtgtcaaaaacacgtgaaacacctagaaagattgcaagatactcccctccccaacgcgtagtcatcttattatcatacatttagatctcctaagtttgggtatcaacattcctacatgaggtgtggagagtggcttagcaactggtgtggctatgtcagttgctaaaatatcaaaatatttccaaactggttggtgagaagctgctgacctgactgtcccccacaaccccaaagatccctccttctcagcaccctggctctcccctagggccctttccagaacaaaccaacagacaggggctgatgccagcatgatgggggcttcaggaccctgtcacagtgctttggctgctgtctcttctgactggtagtgccccagctctccctggttgctaaatatttagaatattgtttctgggcggatgggaggggctgagaagacttgaggaaggatgtcgcggagaagagaagtgaggggaggacaatcaggatcccgaaagccacagaggagtaggtgggtggaaaagcggtcaccaggtggacaggaccaggggacatttccattacttactccggccgcaatcagcagctgttgcgtagcctatagccttggccagcccgaaggtgagcagtcccaagttggtggtggcctcggccgtgtggatcatgtcagctgtgccgagctccacttcagcatacgagaactcactgcctggcacagcctcccaggtgagcttggcccccactgcatgcccatctatggtcagcccgctgatagccttcgtctgtgccactaccagggccacgccctcacagcctggtacactcttgaccacataggctgggcagtaggccgccacatctgggatcaggaccaggtaggggtcataagtcacttcattccttatggcacctgtgccaaacaacaggacctggatgcccacatttgcagacaggtagagtggccaggatggccggacctcaaactctaccacatcacctgcctggagcccacgggagccagtgatacccccatggttgtaggtcagctttgtggcctggctggccacaacgaaggccaaatcatagcgagattgggaggccagcgtgggtactacatagtgggtgccccaggcagacgtgggtagcagctgctcaaccacatggttgcaggtcgtatgtttctgcgcacagctgtggccagagaggacagccacggggctactagctgtgacctttgaccccgagagatccactgagctctgtagctgggccacattgtagggctgtagagtcactcttaggacatcgcctgctggatagaacttgccattgaatgtcactgaccccttcagcgtgacactgaccgaggcacctgcggcaccggccaccacggcaaactccttgacattcctggctgaggtgccggggggtgtgagcacaaaatactcggtgcctagggcctggatgggccgcagcagtgtcagctccgctgtgtcaggcttggcatttagtgcctgcacagagatggcatagtcagaatggatcaccaccgcatgctggaagatcttgctgcctatcatctcagccttggcactgatgttgaccatgaccgactccccgggcctcactgtgaccttctttgaggtgttgtctgcctggctgaggatggagactgaagcggggctctctgacagactggagataaggaggcgggggtaggccttgctgtaggccagctgatagttctgcaggaaggctgtgaggaattcctctctgccagtgttcttgaggtccactgaagcctcctgggtcaatcctggttgagaaaatacagttgtgggtccacttatccaatcctccccacttttgctctgcacccagaaacatgttgaagtattaacttgggctttcccccaccacccttctctttcctttcttctgattcatgcagctttcgtctacaagccttcctggcttttgtttttcaaaaatctaaacaccttagacagggccctcaaactccaatgctgatggggccaggcaagaaatataaatgtgtgaaacagtcccggaggggcgactgtggaactgaagcactcctataccatctaaagtgggttgttgcttatgcaaatccatcagtgtgatacatcttatcaacagaataaaggacaaaaactatgtgatcacttcaattgatgccagaaaagcatttgataaaatttaacatcctttcgtgataaaaactctcaagaaagtagacacggaaggaacacaccccaacatgatgaaatccatgtacaacagacccacagctggtatcatactgaatggggaaaaactgaaagcctttgctctaagatctggaacacagcaaggatgtccactttcaccactattcttcaacatattattgttagtcctagctaaaccacttagacaatagaaaaaaataaagggcatccaaactggaaaaagggcattcaaattatctttgtttgcagatgatataatcttatatttagaaaaacctgaagacagctgggcttggtagctcacgcctataatcccagcactttaggaggccgaggtgggtggatcacctgaggtcaggagttcaagaccagcctggccaacatggcgaaacccaatctctactaaaaaaaaaccaaacattagctgggtatagttgcacatgcctgtagtcccagctactcgggaggctggggcaagagaatctcttgaacccaggaggtggaggttgcagtgagccaagatcacaccaccacactccagcctggatgacagagcaagactctgtctcaaaaaaaaaaacaactttggctgggtgcagtggctcaagcctgtaatcccaccactttgggaggctgagctgcacagatgaagaggtcaagagattgagaccatcctgaccaacgtggtaaaacctgtctctattaaaaatacaaaaaaataattagcctggcatggtggcagacacctgtaatcccagctactcgggaggttgaggcaggagaatcgcttgaacctgggaggcagagatggtagtgagctgagatggcaccgagctgagatggcaccattgcactccagcctgggcaacgagagcaaaactccatctcaaaaaacaaaaaacaaaaaacaaaacaaaaaaaacagaaaacctaaagacttcatcaagaagctattagaactgataaacaaattcactaaacttgcaggatacaaaatcaacatacaaaaatcagtagcatttctatatgcttacagcaaacaatctgaaaaaaaaaaaggaaagtaatcccatttacaatagccacaaataaaataaaacacctaggaataaacgaaagaaatgaaagatctctacaatgaaaactataaaacagtaatgaaagaaatggaggaggacacacaccaaaaaaaatggaaagatattccatgttcatggattggaagacacaatattgttaaaatgtccatactaaccaaagcaatctaccgattcaatgcaatctctataaaaataccagtgacattcttcacagaaatagaagactaatcccaaaatttgtgtggaaacacaaaatacccagaatagctaacgccatcctgagcataaagaacaaaactggaggaatcacattacctgacttcacattatactacaaaactataataaccaaaacagtgtggtactggcataaaaacaaacacatggaccagtggaacagaacatagaacccagaaacaaatccacccacctacagtgaattcatttttgacaaagatcccaagaacatacattgcatttattgaagataaatggtactgggaaaactggatatccatatgcaaagagtgaaactagacccctatctctcaccacatacaaaaatcaaatcagaatggattaaagacttaaatctaagacctcagactacgaaactactacaagaagacatttgggaaactctccagttcattagtctgggcaaaaatttattaagtaatacatcaaaagcacaggcaaccaaagaaaaatggacaaatgggatcacatcaacctaaaaagcttctgctcagcaaaggaaacaatccacaaagtgaagacacaactgacagaataagagaaaatatatacaacccatcttagctaaagcaattagacaagagaaagaaataaaggcatccaaactggaaaaaaaaaaaaaagaagtcaaattatccttgtttgcagatgatataatctgatatttaaaaaaaacctaaagacgccatcaaaaagctattagaactgataaacaaattcactaaatttgcaggatacaaaatcaacatacaaaaatcagtagcatttctagatggtactgacaagggattaataaccagaatataaaaggagctcaaacaactcaataggaaaaaaatcaaataatctgatttgtgtgtgtgtgtgtgtgtgtgtgtgtgtgtatgtgtgtgtgtttgagatggggtcttactctgtcaccccaggccggactgcagtggcacgatctcagctaactgcaacctccgcctcctgggttcaagtgattctcttgcctcagccttccaagtagctgggattacaggcatgcgccaccatgctcggctaatttttgtacttttagtagagacagggtttccccatgctggccaggttggtctcgaactcctgacctcaagtgatccgcctgcctcggcctcccaaagtgctgggattagagacgtgagccaccacgcccggattaatctgattttaaaatgggcaaaagatctgaatagacatttctcaaagaagacatacacatggccagcaggtatatcaaaaaatgctcaacatcactaatcatcagagaaacacaaattaaaaccacagtgagatatcatctcactcgagttaaaatggcttttatcctaatgaaaggcagtaatgaatgctgctgagcatgtggagaaaagggaaccctgttaccctgttggtgggaatgtaaatcagtacaatcactatcgataataatatgaaggtttctcagaaaactaaaactagaactactgtatgatccagcaattcctttccttccaagtcaggaagtcagtatatgtaagagacatctgctctcccatgtttattgcagcactattcctaatagccaagatacggaatcaacctaagtgtccatcaacagatgagtggataaaggaaatttggtacatacaaacaatggagaattatccaccataaaaaagaatgagatcacccggcacagtggctcacacctataatcccagcactttgggaggccaaggcaggtggatcacttgaggtcaggagttcaagacgagcctggccaacatggtgaaaccctgtctctaccaaaactacaaaaattagccaggaatggtggcatgtacctgtaatcccagctactcgggaggctgaggcacgagaatcacttgaacctgggaggcggaggttgcagtgagccaagatcgcgccactgtactccagcctgggcaacagagtgagactcggtctcaaaaaaaaaaaaaaaaaaggaatgagatcctgtcatttgcaacaacatggatggaactggaggacatgatgttaagtgaaataagccagtatagaaagacaaatttcacatgttctcactcatagatgggaatttaaaatttttaactgatgaactcatagaaatagagagtaaaatgatggttacgatgattaccacaggctggaaagtgtagcggggactgggggataagtagatatggttaatgggtacaaaaatacagttaaacagttagataaaatagataaaatctagtatttggtagcagaacaggatgactattgttgacgataatttatggtatattttaaaataactgagagtggaattggaatgttcctaacacaaagaaatgacaaatgcttgaagtgagggatgccctagttaccctgattttatcattacacactgtatgcctgtatcaaaatatcacaggtaccccataaatgcaaacccataaaaattaaaaattttaaaaatatataaactagtaaaaaaaaaaaaagtggattgttggtactagctttcacctgttataatgaaagaatgtgagcttttttaaattgtaagaccttcctgtttttctttttttttttcttctgagatggagtctcgctctgtcacccaggctggagtgcagtggcacgatctcggctcaccacaacctctgcctctcaggttcgagtgattctaccacctcagcctcccgagtactgggactacaggtgtgcgccaccaggcacagttaacttttgtattttttcttttttttcttttgaaatggagtctcactctgttacccaggctggagtgcagtggcgcgatcctgggtcactgcaacctctgcctcccggtttccacgcccagctaatttctgtatttttagtagagatggggtttcaccctgttggccaggctggtctcaaattcctgacctcaggtgatccacctgcctcggtctcccaaagtgctgggattacaggcgtaagccaccacgcctggccgttctttctgtttttaaagagaatgtggctatctgaattttcatgtgaaatctccaacccacaattgttttaagcactttggggctcaaggtggatgtactctgctgccagtgtatgatttccatctttttacaaactggagtgcagtggcttaaacacaacacactgcagcctcaacctcctgggctcaagggatcctcctgtctcagcttctggtatagctgggaccacaggcacgcactgtgtgcctggctcattttttaatttttttctagaggcagggtctcactttgttgcccaagctggtcttgaactcctgggctcaagtgatcctcctgcatcagcctcccgaagtgctgggattacagacgtgaccaactgtacccagctggtttttgtcttaataggacttgtgggggccaggcgcggtggctcttgcctgtaatcccagcactttgggaagccaacgcgggtggatcacttgaggtcgggagttcatgagcagactgaccaacgtggtgaaattccatctctactaaaaatgcaaaattagccggacatggtggcatggggcgcctgtaatcccagctactagggaggctgaggcaggagaatcgcttgaacccaggaggtggaggttgcaattagctgagatcacaccattgcactccagtctaggcaacaagagtgaaactccatctcaaataataataataataataataataataataataataatgggacttgggggtttgtgaaaaggggataaagagaagaaggggattatggaagggtgaatgaattgtctcctagaaatagatggcagtgggggcttctgaccacccccaactaggaagagcgtccctggggctgaggagagagaggtctaaggaatcttgaagagagtgtgggggctatggaatgaccaccttccatataaagggggctttgaaggatatcccagggggccaggggatcaggaacaatggacatttcaaaagtaacctagatggatgctgactggtgacgagagggtcctcatatcccatcctccccccagtactttggctttatccaaaattttagttctggacacatccctgggagaagtggggacaacaccctccaagaatgactttcgtgaaattttccatcaacttagcagaatgaggctcagagtcaaaaccttagttgagttgcagaaaaccaagaaagttcttgcacacttgagtttggggactaaggtttttgcctgtgctcccatccagaaaagggtgagaattggtgaattctaccacatccccctgcagagcctaagggcctctctcctgtctcagctagcctggggtgacatgtggaggaggcacacatggaaggcgtggacccacgcagagttccccagattggaacaaggacatggagagggtcttggtctgacttaccccacaggagggttgctccagcccagagtatccaccagctccatagggcacccatggctgcagtaggaaaagagaaaggatcatagaaggctgatccaccgcctctgctggagactgtcctgggcagaagggcccactctcatgacaagggccacctgggaccatgaaggctgaggtggggaaagaagtcgggcagattgggccagggggtatggatccaaggaccagtgtgtgtgtataggggaggctggctgtccagcgggtctggaggtgggttggggagggcagaagccagggacggggtggagagttggctgtcttgtgggtctaggggtaggatgaggaggcctacagtcaggggcaagagtaggggacctgctgtcccacttccaaaggggaccccagcccttctcacctgcaggtccctggagctgcagggccagccctgtggcagggctatatagtggagtttctgggccacaccctgggccacgtgccaggcagatgatgccaacttcctggaggaggctgccatcctcatggccagatgaaatgggaaactgtgaaggcctgggaaggagggacagtgattctggatgcctgggttccaagaagggagtgaggacagctggtggccattccctggaagccttctggagagtttggtcctggaagggtggggtccctgagggagacagctggggagcaggcagatgagcacctgggtccctgggtggaggtggggtagggtgggggtgtgggcagtgagggtgggaggtggcatgtggtcatatttgctggcttagtggctaggttccttcctttggctcctgccaggaacaacagtgagggacccatatccgggtcctggttccttctcagtccccacaggctggggagtccctagccacccacatcctgcttccagacaccactaggggcaggtgtctgggatgggcaggagtctgaggctatggagtgggacacaagacctccaccgcagcccagtggggcgtctgcggtttctcatctgcaaaatgggaacaccaaaaccagcctctctgggcatctttacgtcccagagatgtaaaaaaattctcaaggactgtagagctggggggcagcctcctctggtgtgggcgcaggccaggctgcaggtgggcactgggactgaggcggtgtgtgaagaagggacaatggcctctgtttcctggttccacacagacacccagattctacttctgatcccagacacctgctcctcagtggtgctggaaacaggatataggtggccagggactccccagcctgtgaggactgaggaagagccaggacctgttggttttggagtttttttgtgtgtagggagggtttgctcttagcaggggctagctgaacaggtttaggggactctgtgcctctccatcaccccagaatttgcctgagatgggaggtggaggtctaggttgcacacaaggagcagaagaatgagctgaaagttgggctttctcagctggagtcagctcctctgaggggctggcctgacccatgccctgcctgccttctccctgactcaggatctcattgtttgctgggggagtctcccctgggaccagcagctgcaaagcctgggtgctctcttggaccaacaccctagcagctgctgcccctggggctcctcctctcttatcacagcagcctgggcctctgggaggccagagcgggtggggggcttctctctccctggagctccaaccaatccccacgcccacccaagaaacgttcctggagggaaagataaaggctaagagttgactgggacataaagtcaaccaggagaatgaggtgagtaaataggagactggctaaaagccagagataacaagaaacaagcaggggcaggggacccacaggaagtggaagctttgggaaaaggatgcctgggtccctgaggggtctaaaagttggtggaaggggctgctgggtccctgagacagagaaggactcggaggaggagacgtcgggattcctaggaggaaacagcaattgcaaaccaagatgtgaaaattctctgtctgaggccaggcgcagtggctcagcttataattccagcattttgggaggctgaggcaggaggattgcttaaggccatgagtttgagaccagcctggttcaagaccaacatagtgagaccctgtatctacaaaaaaatacaaaaattagccaggcacggtggtgcacgcttgtagtcccagctacttgggaggctgaggcaggaggatcacttgaggccacaaggtcaagaccagcctgggcaacatagtgagaccctttctctacaaaaaatataaaaataaaccgagtgtggtggcatgcacctgtagtctccaccattcaggaggctaaggtgggaggattgcttgatcctaggagtctgaggctgcagcgagccgtgatcatgccactgcattctggcctggggagaaaaagaaaaaagaaaataaaatcctctgtgtgccatatgcctcttgtaattagaggcactcagagacaaatgggaggtgaagggaaagaatcagggtgagtttcatgggtgtttctggccctcaattctctctaagccttggggtttcccctggttgatcacagaaagaagcttcctgccttcaaaattcatcatcgctctccacagccagagtccccagaaatggggtggttgtggtgggagatctcacaaattaatactctgtatgtgccaatccccttgggtcttctttctcactccttttaaggcccaagtggtgtgtgtgtgggtgtgtgtgtgggtgtgtgtgtgtgtgtgtgtgtatgtgtgtgtgtacacccctgtgctttaccctgtattatatcaattctcaggaaaccctttggtgacccgggaaataaactctggggacacttccttatggtcagagaaatcgcatccatccctccactggcagccttgctctgagcccaaacaagggtatttgtgtacctgagcctttcggcctcttcctgcttatctgcttccgtctccttgcagcatgggcactggctataccatcccagacccctgggcccctctgactagtcttggctttatagactggagcacagtggaagagaatttactctctccagctaaattcaggcttgcgggcaatttctaacttaattcctttacgctctggatcccacaatccgacttccataagcactgaacgttttgttaaactctccaatgacccattatttgccacttgcctctagttccttccctctaacatttgacattcacacttcctctctgcctataataattgaaattctataggagatgttctctgaccataatggaatcagcttgaaatgaataacagaaaaacaggaaaatctccactcacaaggatattgagcaactcacttctaaataatccatgggccaaagaggaagtatcaaaaatacatagaattaaatgaaaatgaaaagaagatatttcaaaatatgtgggatatagctaaagggaaatttatggcattaaatatttacattaggaaagaggaaagttcttaaaccaatattctaagctcttcttacacaataaagtagtaaaagaccaaaacaaacacaacgcagaagaaaggaaataatgaagagcagaaattaataaaactgaacatgagaaaatcaatgaaacgaaagaactacttctttgttgttgttgttgttgctaacaagagcaagtctttgaatttcccaaatgtatttgtggatttgtctattgttgaatagagcattctataaatatcaattagatcctgttgattgatgctgttattcagttctttgatattctcacatattttatcctggtagttctatcaatttggtgagactgacgtttttaattctccaactatatttgtggacttgtctatttcacctttcagctctatcagtttttgcttcatgtacttgaatctctgttgtttggtacatataccttaggattgcaatgtcttggcagaatgatcctttgtttttagcaatgtttttcgctctgaaggaaagtattttcgtattaatatagtacttccttccttttaaaaatttatatttaaaattatatatatatttatttatttatttatctatttattttttagacagagtctcgctctgttgcccaagctggagtgcaagggcatgatctcggctcactgcagcctctgcctcccaggttcacgcaattctcctgcttcagcctcccaagtagctgggattacaggcacctgtgaccacgcctggctaatttttgtatttttggtagatacggggtttcaccatgttgaccaggctggtcttgaactcctgacctcaagtgatctatctgccttggcctcccaaagtgctgggattacaggggtgagccactgcacccagcctaaaatttatatttataataacataaattaataaaattaatatatatttctattcttttattttcaacctacctatgttgttatatttggagtaaagttttttggagacagtatctagttggatcattttttaaatccactctaccaatctctggccttttatttcatgtaaggagatagactatttacatttaaagtagttattgatatgtttggacttaagattaacattttaatattcattttccatttgttccatttctcattcttattttttcttgcattcctgtgagttacatgagcattttttagcattccattttgattcatattattttcgaatacataatttgtagaattttcttagcacttgctctagtactacaatatacatatgtaactgattataatccaacttatgaatattttaccactttgattgaagtgttgaaactttacatccatatagatccttttaccctcccacttatacatatgcgtgtgtgtgtatacacatataactattttaagtattgtctcttcctatagacatcagataatactataatttttgcttcaaccaactacgatttttaaaaactcatgagaagggtaatctgctatagttatcactatttttgtccattctgctgttcttccttcctttctaaagttctgagccttttcctgtaatcatttggactttggagaacttcctttaatcattctctaaaaataattctgctgacggcaaagtcttgtagtcttccttcatctaaaagctttttatttcttcttcataccccgtagatagttttgctgcatataagattctcggctgggcacagtggctcacgcctgtaatcccagcactttggggtgctgaggcgggcagatcacaaggtcaggagttccagaccagcctggccaacatggtgaaaccctgtctctaataaaagtacaaaaattagccgggcatggtggcgggcgcctgtagtcccagctacttgggaggctgaggcaggagaatcactgggaggtggaggttgcagtgagccaaaagcacaccactgcattccagcctggaggacagagcgagactgtctcaaaaaaaaaaaaaaaaagattctcagcagatagttattttctttcagcacttgaagagtattgctccaggctttcttctccatggtttttgataagaaattttttgtcatttgatcagtgttccctatagacaatttataattcctctctagctgcttccaagatagtttcattgtttgcctttgttttcataagttagttatactgtgttttggcatggaatccgtcagatttattctgtttagcttcttgcatctgtaggtttatgtcttttgccaaatttgggaaggtttggtcattattcttcaaatatttttcagccccactttcttttctccttctgttaatctgataatacaaatgttagctattttataattgtcctgcaggttctctgagcccttgttagtcattttctgtttctcttttttaaagttgattgtctctctgttttttggattgggtaatttttattgttctatcttcaagttcacttcttatttcctttgtcatagttgctctgctcttgagcctttccagtgagtttttattttagttattgtatttttcagttttatcattttcatttgattctttaagaacatactttccatttctttggtgagattttcttttctttcccatctttgcaaggaatttctacttgcttggtgaaacatttttatgatggctactttagatctttgtcagataattctaaaatctttcatctcagtgttagattgttgattggcttttctcattcaagttgtgatttttctggttgttcatattatgtatgatttttaaattatatcctggacatttctggtattatgagaggagaccctggatcctatttaactcttccattttagcagtcactgtttttaggttagcatgcaggtcctggcctacttttgtgtgctatgattccaatgacaatttagttttcagagcccttgcattattattccggtctatttcatttgcctggtgctggttgagctcatacccaattcctgttagtaccaccaatggaggttaaaagcattttcttggggcctgcttggtgctgctacgttaggagtaggagacactggcacaaaagggtggagagtacttccctgggctgcgtggtgccagcagggctcttccttcatctctgccatccactagggtggggaaagcacctacctgggtgctttctgccgctggatagggggctggggagatgctggatctagaccacgtcctgtcgttgggtgggaaattgagagatgctgggccactgagatgtttctcgagttctaaggcccttgtcagttttccttctttttatctttcagagtcctcttaagaatgtctgttatgttattccagggtttttagcagagaggagccaggaaaaataaatctatgtcatcttgacagagatgttaccatcatcctggcttgttgtagtctcctaagatagaaatcaagtgagattaccagacacagtattaaagagaaaaaaaaaaaaaagtttgtttccgtttgtgcagaagggaggtcagcaccgtgaaaggaaaagggtaggctgctccccacagggagcaagtcgatctgtcttgtaggggtccagatgccatgatgtgcctgtcatcatgtgttaacaagggatttcttggcgcctgcacaatggttcaacatggtttttcatacattgcatgtaatattggcattttaaatctctacctctgagcatgatttttagcattgaaataaggaaattatcactgtaagttgaaacctaagctgttcctgtggcttcctggggaagtccctaagcccctaaagcaggaacttgtggttaatagcttcttgggcctctgatgctgactggctggaggttaggtatagaacaggaattaaaagaaataaagaatgtgtaagcaaaacttagttgtatgtaagaaaacccaattccccctgaggaagagaaagagctggagtcctttaaaattaactgcctgtttttctatggctagtgagccttatctctccctttcccaggcattgtgaagactctgtttctctagctgtgcagctgtaagatcactagacagataatctcaagtcgtaaaacatgctgttccttgaaaaaaaaatgatataatgcatgtctcaattgaatgactgtctttgtttctcacttctgtgatatgcttccccctgcacagatctcccccagccccacgaaatgcttaaaaggtagcttgactctttgttcagggctcagtcctttggatgttaatctgactgggtcggtgcacctgaataattaaataattcctcctcaaccccacggtctctctgattccttaattatcctgctgcagacaagctacagcttgagtaaggggcttttgttctttttcactaaaccacctcaaaataggaagccagccagctgtctcactcccagccaagagatttcattctccttattctttttttttttttttttttttttagaccaggagaaataactttatttgaataggacccgagacagcatattgggctaaggaggagaggtaaggttccaaaaccgcagtcaaagctcatcaaccaaatggactctacttcccagcaaccttgcagttagtgcaaccaacaaaaggcctgctggggaatgtatttgccactaaatcccccaagtatgccaacattacaaaaaagatagaggtttttcatcataattgaatttccacaaacctccccaatcacaagtattataagtggaagtaaaaaatcacattttacagatctcaaacttgtcttcaacatttagttcatcatcttcaaaaaatagctcccctgcctaattcattagctatatgatctctccaagcagcaacaagatggccaggccatggcaatcctcttcctatttcccctagccactcagggctcaacagcagggtgaggctcaggtggaggtagggggtggggagcacaagggctacattcccccagtacaacgtggcatctgaagcttgatgggagagcagaactggtgggacttgagggaagggtccagggcctgtattcagtcagaatcactgctggaagaggaggaggaagaggaggaatgcttgtcatgcttgtggtacttgtggtgcttttggtgcttgtgcatctttttatgagctttcttcattttcttctgcatcttcttgtccactatcactgctggtccaaccatgccaggagccaagggattcacaggagggattccaggggcaggcggtgggtatggaggagggtagggacccaacggttggcatcctggataccctggctgtggcacaggatgagggggcccacctggggggaaagctggattgccatggggagctcctgggggaggaggacaggggcctgggggaaagggtggattaataggtggtgggtgggcaggattggaacctccagggcacccaatattggggggatatggatttggccctggctgcccggcattgggattccacatgtttaggtgtgtcctccagcctttccaccgccgcctgggcttgctgcgttctccttcgcagtcctcattctccttattcttaaggagcaaaggtctcttctggaactacttcctgctaagcatggacatagtctctacatctatttccaggaggagtagaaatttcttatggcttgctgaaggggctgatacggctctgggctagtggtctctgaaacaggctggaagcctggcaagaccatttacttggcatgaaagcattacagtctgaaagacgtgaattttaccagcaggttaaacaagcatggtttaaaaattaaaaatttaaagattaaaaactttaaatattaaaagaagaaagatagccaataagggcttaagaaagggaggaaccaagttacaagccttacaagggtaaggttcatctgacagcattgtacactaagttgacttcctttatcaaaagagtgtaaccaatttcctgattgtaaattgcctgggtgttaacctctactcgcccagtagtatttatccaagtgcagcaggaggtatggtgactgtacaaacatcttcctgttcagctaataagtaacctagaagtcttgcacaatgattaacttgacatgaaactattgtagtctgaaagacacaaattttaccagcaggttaaagaagcatggtttaaagattaaaagaagaaagatagctaataagggcttaagaaaggaaggaaccaagttatggagggtaaggcccaagttatggagggtaaggcctagcagttgtccaacaccacattagcaagagaattgagggaggtttttagcctttccagggcctgcctcacctggtccactatatgcctagggctattgtgactccaggtaccctgcacccagactaaaaggaagaggttacagtgagatagaaggtacagtggctgggcgcggcggctcacgcctgtaatcccagcactttgggaggccgaggcgggtggatcacaaggtcaggagatcaagaccatcctggctaacacggtgaaacccccatctctaaaatacaaaaaattagccaggcatggtagcatgcacctgtagtcccagctacttaggaggctgaggcaggagaatcccttgaacccaggaggtggaggttgcagtgagccgagatcgtgccactgccctccaacctggacaacagagtgagactccgtttaaaaaaaaaaaaaaggaagagggtacagtgggagcatgattcatgccaggccctcaccatgtcttgagtatgacctgtgcacctaatagggaaatgatcccaaactatcttacccagctggggtaatattttattattatattgtctgctaaattttccccaagttgataatgtattttaaagcctgatttaagtcttcatctattagaaagtttgtcttgagaaaggactgctccaataggtcattttaaaagggctgagctttaagttcccctttggggtggatcttattcttagtaaggcaatagggaggcacttaatccatgatttctgggcttcttggcatagtgtagccaaggttctttttaagggtttgattcattctctcaactttcccagaagattgaggatgccaggcagagtgaagtttgtattggatgctaagactgctagacagccctttggtgacctaggtgataaaagacagcctgttgtcactttgtagggaggctggaagcccaaacctaggaattccttgtttaagcagccatttactttttgtttgtctggtttggtttggtttttaattttttttttgacagagtctcgttcttgttgcccaggttggaatgcagtggcacgatctcagttcactgcaacctccacctccagggtttaggtaattctcctgcctcagccttcttagtagctgggattacaggtgccctgtgccaccatgcccagctaatttttgtattttttttttttgagacggagtctcgttctgtcacccaggctggagtgcagtggtgcgatctcggctccctgcaagctccgcctcccgggttcacgccattctcctgcctcagcctcccgagtagttgggactacaggcgcctgccaccatgcccggctaattttttgtatttttagtagagatggggtttcaccgtgttaaccaggatggtctcgatctcctgattgtgatctgcccgtctcagcctcccaaagtgcagggattacaggtgtgagccaccgcacctggccttaatttttgtatttttagtagatggggtttcactatgttggtcaggctggtctcaaactcctggcctcaggtgatccgcccacctcagcctcccaaactgctgggattacaggcgtgagccactgcacccggcctttaagcagtcatttacaaacttcaattgctttttctgtttgtgtggggaaagcttccacccagcctgcgaaagtgtctataaaaatcagaatatatttgaattcccctttaggggtatctgtgtaattcgccaatcttctccaggataggtcttcttatgctgcactggggcagagccagtggatgggctcaggaattatttctaagacaaatttcacatgcttgagttacagagtccactgtggcttttttatttttattttttgagactgagtctcactctgtcacccaggctggagtgcagtggcatgatctttgctcaccgcggcctctgcctctcaggttcaagcaatgctcctgcttcagcctcctgagtagctgggattacaggcatgcgccaccacacccagctaatttttatatttttagtagagacgggatttcactaagttggccaggctggtctcgaactcctgacctcaggtaatccacccacctcagcctcccaaactgctgggcttacaggtgtgagccactgcacctggcccactgtggctttttctttctttcttttttttttttttgacaaggtctcgctttgtcacccaggctggagtgcaattgtgcaatcttgactcactgctgcctcaaactcctgggctcgagcaatcctcccacctcagcttcccaagtagttagtaccacagatgcattccaccatgcccagataatttttaaaaatgcttttgtagagacacagtcttatcgtgttgcccaggctggtcctgatctcctgggctcaagcaatcctcctgcctcagcctcctcaaatgctgggattactggtgtgaaccaccatgcctgttaggctgtagcttttaaagccttgctcactaggagattttggattaaattccatagtgagtctctctcataatgagtttcctcatgaagtcttttgatgactttccattggtcagcttctggtaggaaaaggcattgttgctgatcttctagccaccctgaccatttaaattataccctccttcatctgctcagtttttttttttttgatggagtctcgctctgttgcccaggctggagtgcaatggtgccatctcagctcatggcaatctctccctcctgggttcaagcgattctcctgcctcagcctcccaagtagctgggactacaggcatgcaccaccacgcccagctaatttttgtgtattttagtagagacagggtttcaccatgttggccaggctggtctcgaactcctgaccttaggtgatcctcccaccttggcctcccaaggtgctgggattacaggcatgagccatcactcctggccaaccactgccaacttctttttttttttttttttttttgagatggagtctcgctctgtcccctaggctggagtgctgtggtgcggtttcagctcactctaagctccacctcccgggttcacgccattctcctgcctcagcctcccaagtagctgggactacaggcgcctgccaccatgcccagctaattttttgtgttttcagtagagacggggtttcaccatgttagccaggatggtcttgatctcttgacctcgtgatccgcctgcctcggcctcccaaagtgctgggattacaggaatgagctaacgcgcccggcccagctgcccgtttggcagctctatcagcctggttgtttccttggctgattaaagaattgtctttttgatgccctttataggacataacagctatttgggcagggagcttaatatggtttggctctgtgtccccacccaaatctcatctcgaattgtaatcccctcatgtcaagggaagtacttggtgggaggtgactggatcacgggggcagtttccccaatgctgttttcacaatagtacgtgagttctcatgagatctgatagcttaaaagtgtgtggcttccttcactcactctcctgctgccatgcaagatgtgccttgcttccccttcaccttccgccatgattgtaagtttcctgaagcctcccagccatgcagaactgtgagtcaattaaactttctttgtttataaattacccagtctcaggtatgtgtttatagcagtgtaagaacagactaacatagagatgaactgcctcaaggaggaataaaatcgcttcattgggttttgtcggggtgctcctggcagttagcattctcctctttccagacagctgcatgagtatggagcattaggaatccatacttagaatcagtatatatattaagtctcttcccttcttcaagctgaagagcccttaactaaggcttggagctctgcttcctgagctgaagtgcttaggggaagttattttgcctctctggtccagcgtaggctgacaatagcatgttttgccttccgggctccattttatttgtttgtttgtttgtttttttagatggagtctcgctctgtcacccaggctggagtgcaatggcgtgatcttggctcactgcaacctccgcctcccaggttcaagcgattctcctgtctcagcctcctgagtagctgggatgacaggcgcatcacgagcccaggacttcgagaccagcctgggcaacatggtgaaacctgtctctgctaaaatacaaaaaattagctgggtgtggtggcgtgccaccatgcctggcctgcaggctctattttctacaaaacaacccccatctgtaaaccattcttcatctggattctctcaaggggtctcccgtaaatctatccaactagaatagatctgctccaaagtttccacataggtgtgttccagtgtccccaaggtgggcaagggaaggagggtggcagcattcaaggactcatatatctttaaggtcaagtctggggtgtctaacagtggggcttgattttgagttaaccttccccgagttagccagtggctccctttgatttccaacacattctggacctggtaaggagtataaacttcaagggattggcctagcatgagtttggagatatccctgaccaggaggctggtggctgccactgccctaagacagccaggccacacctgggctactgggtccagttgatttaaaaaataagtcactggcctttggacaggccctagcttctgaattaggacttccagggctttgcccagagaggtggaggctatctggaaaccccgggggtagcactgtccaagtacagtggggagcttcctgagtctctggatccttccattcaaaggcaaaaatgtaggtggagtcaggatgcagcatatattaaagaaaacatcctttagatccagtacagtgtaaaactgtgtgcacccagggatttgagagtggagtgtgtatgaattagggactgaaggatgtgtgggaacaactgagtcattcactactctaaagtgtggaagaaactggtattctacatttggtttcttcacaggcaggactggagtattacaaggggactgcagggctgaattagtctgttctgtatcaatgtttccaggaggggccatatcccttgtagggcttctggcctcaaatggtattttggcttgcgtgggtagggtaggcctggcttaagctttattttaatattctcctcattgatgacctgtcctgaaatgttggtatcccatacagacttttccactcaaatcaatatcttttctaggactgggggtagcttctgatcttggggaaccaaaagggccagtaaatggattcctttctcaggaggcactgagacttgtatggcattcccctggagggaaactgaggctcccaacttagataataagtcatgaaccattaaaggaaggggacactcagggacatataggaaggaatgagtgatagccttagatccaattttacaagtcaaaggaaaggtaaactgtcttaccttgggttgtccatctgttcccgtcactgtacaactggcgctgaacagagatccatcaggatgggtcaggacagagtagggggctctggtatccataaggaattcagtttcctacctgccatattgagggtgacccaaggctccacagtggtgatggtgatggaactcttcaggactggaggcagataagcatttgagaacacctcattcagagggggtagcctttttatttgagaggccagcaacaagaggagtgggctggggaggtctactccatcctggcttcccagaaaagaatggacagtcctttctccagtgcctcttcttacagtaagcacactggttgcaccccatttccatggacattgggtggggtttaatccccacccccccgcattcaggtttctctgttacctaaggtcacctcaaggtgggcctatgattatagcagccaaaatgtgtgtcttcctttttattctctcatttttctacaccttctctgcctggtcccagttgttaaaaatgttgaagacctctgctaccaacgttgcttgaagggtctaagggtcagctttcagcttttgaaggttttcccaaatgtctggcacagcgtgggttataaaatgcatggccagaagtgttaggccttcattggtccttgggtctatgttactatactttctaaaagcctcagagagcctattaaggtacccagctggattttcatccacttcctgagcaattattttactttattatactttactggttttgtctgacaccctctgatatgcaattaaggaagtgattgatccttaaccagtccctgtcatccgtataaacccattgcgggttctgctctgggactgcctcaccagatacccagtaaatgacatggccaggattatatctggccatctcctctgcatatttcttaccctttccaagattcgagttttttcaccaggagtacaacaacgagttaggactacaagaacatcttgtcaagtcaaaggaaaggttagactaaacttaataaattcatcactaaacctatctggattgttcaagaaccggccaaaccaatccttgccttgatttatgtctgacattggtaagggtccatgtacctgagttgcccctctagttccatccgttacctcccagggggaaagcagccctggtatggtggggaagtgaaggagggtgctgacttggagcccagttggagccacactggggacagcactgagggttgttgaggagtagaaggggaaagccttcctgacccagcatggtatggaggaggctccagacagaaggagaaaggatccacagtagcagagaggcctgcttcccaccctgcccttagaaaggtagtgagagaattgagccctaggggttaaaatctgagacaggacttggctcatctctcagctgttgcttgagaggtaccatataaacctggcaggagtcctagagtttgagatccagatataatttcctgaaggcctgcatgtatggaatctcaagctatttattagaattttttacagtatatatccaattggaaaatgatgttgtaactgaaggaccccattctcaggtcatttctcttggtaccccaggggatactgaggccaagcaacatcacagagaaacacgagcttctttttctttgtaatatctcatttaaactgatcccaattacagaggatgcatccaagggggggaatcttttgggacgtctgtagtgtttcccatggtagagctggtgtcctgtaatcaagaggtctggtgagggatgcagcctctgactctgacagtcttcacaattgcagcacacatcctggtctgactcatcccagaccttcaaatccctggcaagaactaagcaagccaaagaggacagagggaggagagcagaacgagggggcttgagagcctttagctcttggatttgccagcttcaacccacaaagtctagcaagtagtagattttacatcagctccaagtagaacttactctacacccacatttatttacatggactctaacaagaaacgagatgatgtactagacagaggaaaaatttcatctggcctaatgagtaaggcttccttccaagaatcctggagggtggcttcacccatgcaacaaggaccagaaacaagaacgcatttccattcagacaactgacaaaacagattataaacgtccaggctccacaaagaagaatacggtcagggaaaatactgagtggtttcagtatttgaaacaaaagagaattccagattgccggctggtacctagcccacacatgtctggggcagttccctagaccaatctcagaagggccagccagaatcactccaactgcctacgcaagtttcccagaagggctaactggaatcaccccaacttcccacccaaatttccaaaaataagggagagaaggagagacaaaagaaagaaagaggcccttatcaatgtcagacataagtcaaggcaaggattggtttggccggttcttgaacaatccagataggtttagtgattaatgtattaagtttagtctaacatttcctttgacttgacaagatgttctagtagtcctcactcattgtactcctggtgaaagtttcaaatcttggaaagggtaagaaatacgcagaggagatggccagatataatcctggccatgccatttactgggcatctggtgagagagagagagagagagagagagagagagagaagaagaagagcagactcacctagggtccagacttgactctccaaagcaccaacaccaaagcaatggtccagagtggccacctttgttaccacctggtcagttgcctctgtcctccaggaagtcttgctaactcctgtggggacctaaaatgagggtcccatctggggtaccaggagatgttacaatcatccttggttcttgtagtcttccaggatagaaatcaagtgagattgctgggtgtggtggctcacccctgtaatcccagcactttgggaggctgaggcaggtggattgcttgagcccaggagttcaagaccagcctgggcaacatggtgaaaacccatttctactaaaaatacgaaaaaaaacagctgggtgtggtggtgcacacctgtaatcccagctacttgggaggctgaggcaggagaattgcttgaacctggaaggcagaagttgcagtgagctgagattgtgccattgcactccagcctgggcgacaaaacaagactccatctcaaaaaaaaaaaaaaaaagaaagaaaaagagaatgtttattttagcttgtgcacaagaaaggtcagcactgcaaaaggaaaagggtgggctgcaccccaaagggagcaggttgatctgtcttataggggcctagctgctgtgacgtgcctgtcattgaatgtttaggagggatttctttggtgcctgcacagtggttcaacacgctttttcatacattgtatataacattagcattttaaatcacctctgggcatgatttttagcattaaaataaggaaaagttgaaacaagcctagctgtacttgcaggtccctggggaagtccctaggcccctaaagcaggaacttgtggttactagcttcttgggcctttgatgctgattggctggagattaggtaagctacatcttgagtaaggggcttttcttctttttctctggaccacatcaaaacaggaagtcagccagcttgcctgtcacaaaaccaggagtcaataaataaaatgatttattatttgaataatgtatttgtaggttcttttgggttctctacacatacaatcatattgcttatgaattagtttaattccttccattctcatctttataacttttctttaggctttccaatagataattgaataaaagatatgatgggggcatcctagtcttgcttctgatcacaaagaaaatactttccattggtttttgttgttgtttgagagggagtctcgctctgtcacgcaggctggagttcagcggcacaatctaagctcactgcaacctttgcctcctgggctcaagcgatccttccatcttagcctcccaagtagtagggactacaggcacatgccaccacgcccagctgatttttgtatttttctgtaaagatggggtttttgctcaggctggtctcgaactcctgggctccagtgatccacctccctcagcctcccaaagtgctgggattacacgcatcagccactacacccagcctgttttcaatattttgctattaagtatgatgcttaccgtagcatttttgaaagtatacattattgtattaaagaagtttccttctacttttaattgtttaatcataaatagatgtttaactttatcaaatgatttttctgcatctgtctcaatgatattaatatccattgttgatcattaccttgatgtagagttgctaactaagatacaagacctccagttcaatttgaatttcaggtgacaattaatttttagtataaatatgtcccatgccatttattggctaaatctggaaacctgtctagttccattatttcaccagggctttgcaaaatggggatttttaatgtattattttctcttcatttattaactacaatgctattatacaaagaagcatcccctcattaattctctggttaccctaaattgtagttaatacagaaaaagcaacttaaatgcttcaattttcagttttagtacattctctctaaaggtaaccaaaacgtgtgtgtgcgtgtgtgtgtgtgtgtgtgtgtgtgtgtgtgtgtatgtaatatccttatgaatgcatggatttttaacatttgaagtggtcaaaccttagaccagtgggagctgtcttggtttatggtacatttcctacccagaaccacaatcatccatttctaaaagagccacaattcctatgattaccaaattgtatttatttatttattttgagacaaagtcctgctctgttgctgaggctggagtacagtggcatgatcatggctcactgcagccttgacctcctgggctcaagtgatcctcctgcctcagcctcccaagtagctgagactacagacgtgcatcactacacccagctaatttttaaattgtttgtagagacaaggtctccctatgttacccaggctgctctcaaactcctggattcaagtgatcctcctgacttggactctcaaagtgctgggattataagtgtgagccacgtgcctggccccaaattgaatttagacactataatttgagcactaggggaggaactgcctttaatatttttaattttgtaaaacatttgcacagttccagagccaaaacttgacaataagttatcttcacagagctttagctgccatccctgtcctctccacatttcctcccttctcctgtgagtaaccatttttatgggattttcattcaactttccatcatttctctttgaaaatatagggaaagacatacatatacaagtgtgcgtgtctgtgcatttccctttccttcttttgcaaaaggtagcatattatagcatatcatacacattgtgttttcttctttttgttttgttttgttttgtttttatgagaccaagtctcactcggccgcccaggctggagcgcagtgtcacgatctcacctcactaacctccacctcccaagttcaagcgattctcctgcttcagccactcaagtatctgggattacaggtgtgtgccaccatgcccggctaatttttgtattttttagtagagacgggtttcaccatgttggccaggctggtcttgaactcccgacctcaggtgatcctcccacctcagcctcccgaactattgagatcacagaagtgagccactgcgcccagctcacactgttctttattttactttttttacttgacttttttttttttgagacggagtttcactcttgttgtccaggctggaatacaatggcacgatcttggctcaccgcaacctctgcctcctgggttcaagcaattctcctgcctcagcctcccgagtagctgagattacaggcatgtgccatcacgcccggctaattttgcatttttagtagaaatggagtttctccatgttggtcaggatggttttgaactcctgacctcaggtgatccgcccacctcagcctcccaaagcgctgggattacaggcatgagccactgtgcctggcccatgagccaccacgccaggcaggcacgtactatttttcattcccactagcaatgtgagagtgccaattttcccacaaccttggcaagagtatgttatcaatctgataggtgagaaatggtatctcgatacagttttatgttgcatttgtagtatcatgagataaatcatttgttcatttaagggtttgcattttctatgaattctgttcttttgttttcttaccttgttgtgtttttgtcatgcataaaattgtaattattatgtagtcaaatgtatcagtcctttcttttattgcttctgtaatttgaatcaggtagcaaaaaaaattgaccactgccaggttataaagaaattcattggccgggcacagtggctcatgcttgtaatcccagcactttgggaggtcaaggcaggaggattgcttgagcccaggagttcgagaccagcctgggtaaaattgggaagttctatctctaccaaagaattacaaaaattagccagttgtgcaggtgtgtgcctgtagtcccagctattcaggaggctgaggtaggagaattgcttgaaccaaaggggcagaggttgcaatgagccgagatcatgccactgcactccagcctggacagtagagccagaccctgtctcaacttaaaacctaaatgaataaattcattcacatttagtagttacagggtttcacattttaaaatttagatctctgaccttttcacatttgtcctgctgtgtggtttgaggaatgggtttaattttatattcttccatagagttgtcagcttactccagtatcactgattaaaaagtccttcttgtctccaatgatttgagatgcaacctttatcatatactaaatatctatatgcatttgggtctgctctggattctctattctgttccttcattctgtggtattcatgtgctaataccacactgttttcattagaggttttctgttttaatatctagtcaggtcggccaggcgcggtggctcatgcctgtaatcccagcactttgggaggctgaggcatgtggatcacgaggtcaggacctcaagaccagtctggccaacatggtgaaaccccgtgtctactaaaaatacaaaaattagctgggcatggtggcacgcatctgtaatcccagctgctcgggattacaaaaaacaagaacagctaagaaagttctgaaaaactcaggaggctgaggcaagagaatcacttgaacccaggaggcagaggttgcagtgagctgagattgtgccactgcactctaggctagcgatatatatatatatatgtgtagtcaggtcagtggtgcctccctactctggtctttttcagaattttcttagctgttcttgtttttctcattctcccaaataagttttacaataacttctctaattctagataaaaacctgatgatatttttggagggattgcattacatttttaaactaactttttgagagatatttttattatgtgagtctcctatccaaaaccattgcccttccatctatatatgttcatgtttacctttgtgaataatagaaaagcagacactattcacgtttatctttaaaaaaaaaaaaaaaaaaaaaagcaaaataggccgggtgtggtggctcacgcctgtaatcccagaactttgggaggctgaggcaggagaattacttgagtccaggagttcaagaccagcctaggcaacatggtgaaaccccatctctacaaaaaatcagctaggcatggtggtgtgcacctgtagttccagctactcggaaggctgaggtggtgtcaggcctctgagcctaagctaagccatcgcatcctctgtgacttgcacgtataagcccagatggcctgaaataactgaagaatcacaaaagaagtgaaaatgtcctgccccgccttaactgatggcattccaccacaaaagaagtgaaaatggctggtccttgccttaagtgatgacattaccttgtgaaagtccttttcctggctcatcctggctcaaaaagctcccccactgagcaccttgcgacccccactcctgcctgccagagaacaaaacccctttgactgtaattttcctttacctacccaaatcttataaaatggccccacccctatctccctttgcccccaccctatctcccagagtagggaggcaccactgacctgactacatatatataaatatatatatatatatatatatatatatatatatatatatatcgctagcctggagtgcagtggcacaatctcagctcactgcaacctctgcctcctgggttcaagtgattctcttgcctcagcctcctgagtttttcagaactttcttagctgttcttgttttttgtaatcccgagcagctgggattacagatgcgtgccaccatgcccagctaatttttgtatttttagtagacacggggtttcaccatgttggccagactggtcttgaggtcctgacctcgtgatccacatgcctcagcctcccaaagtgctgggattacaggcatgagccaccgcgcctggccgacctgactagatattaaaacagaaaacctctaatgaaaacagtgtggtattagcacatgaataccacagaatgaaggaacagaatagagaatccagagcagacccaaatgcatatagatatttagtatatgataaaggttgcatctcaaatcattggagacaagaaggctgactctcttttcggactcagcccacctgcacccaggtgattaaaagcttttattctcacacaaagcctgtttagtagtctcttcacacagacatgcatgaaaggtgggaggatcacttgagcctgggaggtggaggttgcagtgagctgagattgtgccactgcacgccagcctgggcaacagagacatcctgtctcaaaaaaaaaaaaaaaacagtaaaattgatatgtatagatttgtgtaaccacctccatgaaggggtaggttgcccctccacacctctgggtgtttctcgttaggtggaatgagagacttggaaaagaaagagacacagagacaaagtacagacaaagaataaagggggcccagggaactggcgttcagcatacggaggctccaccggcctctgggttcccttagtatttattgatcattcttgggtgtttctcggagagggggatgtggcagcgtcataggataatagtggagagaaggtcggcagataaacacttgaacgaaggtctctgcatcgtagacaaggtaaagaattaagtgctgtgctttagatatgtgtacataaaaacatctcaatgccttaaagaacagtattgctgcccgcatgtcccacctccagccctaaggcggttttcccctatcttagtagatggaatatacaatcaggttttacacgagacattccattgcccagggacgggcaggagacagatgccttcctcttgtctcaactgcaaagaggcgttccttcctcttttactaatcctcctcagcacagaccctttacgggtgtcgggctgggggacggtcaggtctttcccttcccacgaggctgtatttcagactatcacatggggagaaaccttggacaatacctggctttcctaggcagaggtccctgcggccttccgcagtgtttgtgtccctgggtacttgagattagggagtggtgatgattcttagggaggatgctgccttcaagcatctgtttaacaaagcacatcctgcacagcccttaatccatttaaccctgagttgacacagcacgtgtttcagggagcacagggttggcggtaaggttacagattacagaacaaaatggagtctcctatgtctacttctttctacacagacacagtaacaatctgatctctctttcttttccccacacctccacaatcaagatacagtttcatcaccccaaaacttctctcatgctgtccttttgtagtatccctccccaccaacccctggaaaccagtgacctcgtctctgttcctttaatcttgtgttttcaagaatgtcatacaaatggaatcagaaagtacgtcacctccagtcctatgtacccatttgactatggaaaatttccactcgaatgtcccacaggtaccttagctcaacctcattgctctccttccaatatgcccctcctcctatgtctagattctagtcaaacactatgccatcatccagcagtccaagctaggagtgtcatcctgggttcctcttttttcctttcacccttctttctaattattcttttttttttttttttttttttttttttgagacagagtttctctcttgttgcccaggctggagtgtaatggcacgatctcggctcaccacaacctctgcctcccgagttcaagtgattctcctgcctcagcctccagagtagctgggattacaggcattcaccaccatgcccagctaattttgtatttttagtagagacggggtttctccatgttggtcaggtggttttgaactcccgacctctggtgatctgcctgcctcggcctcccaaagtgctgggattacaggcatgagccactgcacccggctctaattactctcttaatctcattgcttatatgttctttatatctctcaaaacaatctatttctaaatccacaaccattttacaagtgattctggcaaccacctctcaactggattattccaacagctttctgggtttttttgctgagtcttatccttttgagtctctatctacatcacagtaagcatgatcatcctaaacaaacacaaatcttgttaagtcattcccccaatcccccactccctgccacttaaaacccttcacgggttgtcccttgccctcaggacaaattgtaagctccttaggtgacattcaagacttcctataattcaagccttcctctcctatctcaacccaaaactcctgttctcaccctacatgtctcccacacatactcccacttgggttgcttttttaaagtctggaatgtctttctcctcgcctttgtttttttttctttcttttttttttttttcttttttgagttggagtctcactctgtcacccaggctggagtgcagtggcgcaatctcagctcactgcaacctctgcctcccgggttcaagcaattctcctgcttcagcctcctgagtagctgggattacaggggtgcaccagcatgcccagctaattttctgaatttttagtagagatgggggttttaccatgttggccaggatggtctcgatctcctgacctcgtgatccgctcacctcagcctcccaaaatgctggtattacaggcatgagccaccacgcctggctctcctcacctttcttagctaattagtacttgtccttcaggtctcaccttggctctaacctcctggctggaccaatgctctacctttctaattcctgcaggaaaacactggacttttctctttttccttagtagagaagttttcaaagtgggactgcagacccttgcatgtccctgatcccttcagagggtccctgaggtcaaaactatttttataataatactaagatgttattcaaatttttcactcttaatatttgcactgatagtgcaaaaacaatggtaagtaagactactggcccttgccccaaatcaatttagctaataatcatcagattaatggaatcttcttgttttaatattacaccaaaactctacaagtggaagtatcttaaaggttagttgcaatatggtgtctgaaacgatatcagtgaattatttccatgctattacagtaaaatcccttggtctatattgcactttgcatggatcttttacccattcatagttttatagcatcatgcaacaggaatttggaaaatattggtgcagtgagttatacagctttccaaatgttgaaacatttgttataaaatactgaaaaattatagtcatagatatccacatcattctaatctgaaaggcaataagcatttgggaagctgtcaagctcatggtggcagattaaatatacttccatattaccactacttatatatgtgtggctacattttttttggtatacgttaaccgaaacaaactatcacagcacattgaatgcaaaagcagacattggccaggcgcagtggctcacgcctgtaatcccagcactttgggaggccgaggcaggaggattgcctgaagtcaggagttcaagaccagcccggccaagatggcgaaaccccgtctccactaaaaatacaaaacactagccgggcgcagtggctcgcacctgtaatcccagctacgtgggaggctgaggcaggagaatcacttgaacctgagaggcagaggttgcagcaagccaagatcgtgccattgcactccagcctgggggacagagtgagactctgtctcaaaaaaaaaaaaagcagaaaaaaaagcagacattaagatccagttgttttccatcaagctggacattaaagagatttgcaaaaatgcaaaacaatgctactcttctctgaccataatagaattaaagtagaaatcaattaacagaaagatgtctaggagatgcccaaatatttggaaattaatcactcacttctaaataatccaggagtcaaagaagaagtattaagaagaaatagaaaatatttttcacttaatgaaaataaaatataacaaaatgtatgtaagcaattaaggcagtttttagggggtaaatttatattagcaaacacatatgtcatgaaagaaaatctcaaatctaaccctccacgttaatattgtagaaaaagaaaagtaaatgaaatccaaagcactgaaggaaaaagaaaataaagagcagaaatcaatgaaattaaaaacaggaaaaatcaatgaaaccaaaaattttccttatgaaaggtcaatacaactaataaacctctaaccagacgaaccaagaaaaaaacagagaagacaaaaattacctatattaggaatgatagaagagatatcactacagtatctataaattttacaacttacatgtaatagatcagtcccttgaaagatacaaactaccacaattcaccaaagatgaacaagataaagaggtcttagaactattaaagaaattaaatttatagttaaatatcttcccccgaaaatctctaggcccagttttattggagaatgttatcaagtattattgaaagaaataacatgaattctaaaaaattctctttcagaaaatataagaggagaaatactttccaatttgttttatgaggctagcattgccttgataccagaagccaaagacactacaatgaaagaacactataaatcagtatccctcatattagcaaattgaatctagcaatataaaaaggacaattcatcatggtcaagtagggcttatcctgggaatacaaggtctgttcaaaattttcttgacaaaagtgaacatctagcagggcgtggtggcacacacctgtaatcccagcactttgggaggctgaggcaggcagatcacctgaggtcaggagtttgagaccagcctaactaacattgtgaaaccctgtctctatactaaaaatgcaaaactagccgggtgtggtaggaggcacctgtaatcccagctactcaggaggctgaggcaggagaattgcttgaacctaggaggcgaaggctgcagttagccaagatggcaccactgtactccatcctaggtgacagagcaagggttcatttcaaaaaaaaaaaagtgaacatccattcagggtttaaaaaaaaaaaaccaactcagcaaactaagaagagaaagaaacttccttaatctgctaaaagggcattttgaaagacacttaatgttagaagtctaaatgctttccaccaaagattgagaacaaagaaaagaatgtttgcattcaccactcctagtcaatattgtactgaaagtcctggccgatgtaataagtaggaaaaggaaacaaaagtaatgtcgattgaaaaggaagaaaaataaaactgtctttattcactaatgacatagttgtcacaaaaaaaactccaggaaatctacagaaactcctaaaactaataaatgatttttacaagatcacagaataatgtgcaaaagtcaatcatatttttaagcataaggaaacaaaaatcagaaatttaaaaaattttaataacatttataatatcataaaatatgaaatacatagggataacctgacaaaagatttacaagacctatacactgaaaactaaaaaacattgctggtagaagttaaggaatggctaaataaattgggagattgccgggcgttggtggctcacgcctgtaatcccagcactttgggaggccgaggcaggcggatcacgaggtcaggagatcgagaccatcctggcaaacacggtgaaaccccgtctctactaaaaatacaaaaaattagccaggtgcggtggtgggcgcctgtagtcccagctactcgggaggctgaggcaggagaatggcgtgaacctgggaggcagagcttgcagtgagccgagatagcgccactgcactctggcttgggtgaaagagcgagactccctctcaaaatataaattaaataaataaataaataaataaataaatagggagatataccaggttcatagattataagatttaatgctggccgggtgcggtggctcacgcctgtaatcccagcactttgggaggctcaggttgggggatcacgaggtcaggagatcaagaacatcctagccaacaggcctagccaatatggtgaaaccccgtctctattaaaaatacaaaaattagccgggtgtggtggcgcacgcctatagtctcagctactcgggagcctgaggctggagaatctcttgaaaccgggaggcggaggttgcagtgagccgagattgtgccactgcactccagcctgacaacagagtgagactccatctttaaaaaaaaaaaaaaagaaaaaagaaagaaaattagatcaacagaacagaatcaagagtccacagatagatgtacacacatgcataatcaactgatttttgacaaagctgcagggcatttcagtgggaaaagataatgttttcaataaatggtactggagcgactgggtattcacatgcaaaaagatgaaacttcggccaggcacagtggttcaggcctggaatcccagcactttgggaagccgaggcaggtaggtggatcacctgaggtcaggtgttcgagaccaccctggccaacatggtgaaactccatctctactaaaaatacaaaaattagccgagcgtggtggcaggcacctgtgatcccagccactccagaggctgaaggaggagaatcgcttgaaccttggaggcagaggtgcagtgggctgagatcgcaccactgcactccagcctgggcggccgaatgagactctgtctcaaaaacaacaacaacaaactcgaaatggaacatagatgtaaatgtgaaatatcgagctatcaaacttcttcttcgccccccaaagtgctgggaatacagatgtgagccaccacacccagccaatcgaactatcaaacttctgaagaaaacatttaaaaaaactttgtgagttttcaccaggctaaggtttttaaaaatacaacaccaacagcatgattcataaaagaaaaaattgataaattggacttagaatccacagtggtacatgccaccatgtcaggctaatttttgtatttttaacagagacgggtttcaccatgttggccaggctggtctcaaacttcagacctcaagtgatccacctgcctcagcctcccaaagtactaggattacagatgtgagccattacacccggcctttttttcaaatttctaagaaaagagattttttttttttgagatgggagtcttgctctgtctccaggctggagtgcaatggtgccatcttggctcactgtaacctccgcctcccaggttccagcaattcttctgcctcagcctcccgagtagctgggattacaggcacacgccaccacgcccagctaattttttgtattttttagtagagactgagttttaccatgctggccagactggtctcgaactcccgactgcaggtgatccactcgcctcggcctcctaaaatgctgggattacaggcgtgagccactgcacccggcccaaatcactgtattttggaaaagataagttcaaaaattagccgggcgtggtggcagacacctgtaatcctagctacttgggaggctgaggcaggagaatcactggaacccaggaggcagaggttgcagtgagccaagattgtgctattgccctccagcctgggtgacagagggagactgggtctcaaaaaaaaaaaaaaaaagaaaaaagaaaagaaaagttcattgatcctagcccttgcctctgcccgtgtgtaggaaaatatcgaagaggattaatgattatgtgtcacacccaaaccttgatgggattttgctctcatgtaacttctgagaacatgagctgcagccacctgtataaaaaccgcaggctgaaaccctccggagcagtccaacggttactttgaaagactctcccaggttgtgatcctcagtaagacttctgaatcaaactaactttaattctctaaaagtaggtttttctctttccttttttttttttttttttttttttgagacagggtctctcactctgtcgcccatgctggagtgcagtggcacaatcttggctcactggcagccttgacctcctaggctcaagtgattctcccccctgagcctcctgagtggctggaactacgggcgcacgaccatgctgggttaatttttataaacattttttggtctcactatgttgcccagggtggtcttgagcttctgggctcaagcaaccctcctgcctgcacctcccaaagtgctgagatgattataggagcaggaatgagcacttggcctgatttttgtcttagttgacaatagtcagtgttcaggaaatggttatttatgattattatccataaaaattccaaagggatacactgatttgtcattaccaaaggggccagagagaacctggcaattatttgggcttaggggaataaaggcaaagctctcagatgagtttcagtctgaagcctggaaacagggaggatgggaggccaggggcaagatgatggattccattttaagtaatagattctaagtctcaagtaaaaatcaaggttgccttttgggtgtaaggtagaaacctgggatacagaattaagaattgcccatgttaggcacggtggctcacgcctataatcccatcacttttcgaggcttgggagggtagatcacttgaggttaggcatttgagactagcctggccagcatggcgaaactccgtctctactaaaaatacaaaaaattacccaggtgtggtggcccacgcctgtagtcccagctgctccagaggctgaggcatgagaatcacttgaacctgggaggcagagttgcagtgagccgagactgtgccactgcactccagcctgggcgccagagcaaggctctgtctcaaaaaaaaaaaaaaaacttacagaattaagagttgctcatgcagaggaaaacaaaaagatttattgtcattgtcgttttccttttttttgtggaaacacagacactaggactttaagaaaggcaggagccagatctaatgaatctctgggttctcccagcagagtgatcctccctactcagtgatctccactgagcaggagccaccaattctctttgtaacttaatggaagtggctttcccctgtctgcacctcagtttcatttgtaaaatgaggaaaagcaaacctacctctgagggctgttatgagatcatggtttggaattttcctggccaaaagtgaatgcgcaagtggtgtctcgtgtgacaacccatgatccatccaccaaatagaaaacaatgtccaaacacacaaaatatcaagagtatacatacaaatggtgggagtgtaaattaatacagtctgacagtgtctactaaagctaaacacatacctgccctacgaccagcaattccacacttgggtctattttgtttttgtttttgtttttctttgggagggggatctattttcagaagaaatgaatacgtaagtttgtccaaagaaatgtactagaatattcatagtgagagacaggactagctggatttcctaggccgactaagaatccctaagccaactgggaaggtgaccgcatccacctttaaacaaggggcttgccacttaggtcacacccaaccaatcaggtagtaaagagagctcactaaaatgcgaattaggcaaaaacagaaggtaaagaaatagccaatcatctaacgcctgagagcacagagagagggacaatgatcggcgggatataacccagcactggagcccgcaaggcaatcccctttgggtctcctcccattttatgggagctctgttttcactctattaaaccttgcaactgtacactcttctggtctgtgtttgttatggcttgagctgagctttcgctcactgtccaccgctgctgtctgctgccatggcagctgtggcagacctgccgctgacttccacccctccggatccgggtgtccactgcacttctgatccagcgaggcggcacccattgccgctcccaattgggctagaggctcaccattgttcttgcgcgggctaagtgcccggggttcctcctaatcgagctgaatagagctataacactcaccgcatggcccaagattccattccttggaatccgtgaggccaagaaccccaggtcagagaacaagagacttactgccatcttggaagcggcccaccaccatcttgggagctctaagaacaaggacccccagtaacaatagcactataacacccctaaactggaaaatatccagtctgaggtatagggcatagtcataaaatggaaaccatccagaatgaaaatgaaagaactatttctacacacggtatgcatgaatctcacaaaaacaacattaactaaaagaaaccaaacacagtacacagagtactggtctagagagaaggagaattcaaaacaaacaaaagtaacccagctgttacaagtcagggcgagtccagccaggcacagtggctcatgtctgtaatcccagcactttggaaggctgaagtgggaggatcatctgagtccaggagttcgtgaccagcctgggcaacacagcgaaaccctatctctacaaaaaacattttaaaattagcaaggcgtggtggcacacgcctgtagttccaggtgcttgggaagctgaggtataggattgcttgagtctgggaggttgaacctggagtgagtagtgatctcaccactgcactccagcctgggcaacagagcaagaatctctttcaaaagatatatttttaaaggctacatggggtgggtcatgcctgtaatcccagtgctttcagaggctgaggagagaggatagcttgaggccagcagttggagactctagtgagctatgatcgtgccactgcactccagcctgggcgacagagactctagctcttaaaaaaaaaagaaaaaaacagatgaatgataacctttagaagggatcgggaggccggatgtggtggctcacgcctataatcccagcactttgggaggccaaggcaggcagatcacttgaggtcaggagtttgtgaccggcctggccaacatggtgaaaccctgtctctactaaaaatacaaatattagcctgggcaacagagtgagactccgtctcggggcggggagtggaggggggagaagaagggatgggggaaaggggagcacatgaggcttctactgtttggttttgcgatctggattcaggttgtatgggcatgttcactttgtgtaattttgtcgagctgtaatgatttgtgctcttctctttatttaacttcaataaaaggtttacttaacaaaaattgtagctggtgtgaagggtagcagtgtttccctggggccaagagtacaggctttggggacagacagacctgggtcccaatctatgctttgtcccttcggcacattgttgactgtggctggtggcttcgtggctctgagcttgtctccttctctataaatgaggaaacataatacttgcgacgatgatgcctgtaaagcttaagcgcaggacctggcatagatctgtaaggcggaaacctgggatacagaactaaggtctatggatctcctgtgctacccaacttctgggcactcgctgcctccttttccccagcccagacgcgtgggttctactcgattggttgctcactgcgggctcggggctcctcaatcccggggtaaagcccagtatgaaatgtcaccttcaggggcagctcggatcttcccacgcccgcgcggcgcacaatctttggatcagcgccacgtggagaccttacccgcccgtacgatcaatcccttctgtggaacccagctcaaggaccctccagcccagacactagaaagcgaagagcagttggccgccagactgtccgtgccagagctctgcgaacttactccgttgaaagagcaacggggctgcgccacctcccggagagaacccccagccctccacggcagggcgagatggcgccaccgcgtgatactgcgcacgcccacagctcccgtcccgccctcgcgcctgcgggtacggacagcgcatgagcttatgttgagggcggagcccagaccagcccttcgtcctatcctgcccttccagcacctctcagccgtaacttaaactacacttcccagaagcctcctcagccagggacttccgttgtcgtcagcggaagcggtgacagatcatcccaggccacacagaggccggcttggtcactatggaggagataggcatcttggtggagaaggctcaggtacagtggggacttgggctttttagtccgggccgggctcgcggggagagggtgaagccagacctgagtggggggaggaatggcttccaggaccccggcccaggttggggttattttagaggcctcggtggagagctttgtgccattcgaaggcctgtctgggtggccgagtgatggtaggaggtaaggctcagaaagcggggctgggggagtgagtgacgttagtgggtctttgagacggattgatttcgaaccctggccggtagtgcttagtgaggtcggtggcccggcgttgggattgggtcaggcggtgagtgatatatgggatcccgccgtgcggccgagtgatccccgggtctgggctgcggggctgactgatgttcagggctttgctgatgggggtaatggggcgggtagttaagtattatctgtggcttgcctgagtgatatttaggtctaaggtgagttaggagactgtgacataagggatctttgaggggaaactggggaatgttgggactcgttgaaggcgcagtcactttaacagcctatctaggagagccatgtgacattaggaacctcttgaaggggattgggtggcatttgggtctgataaggagttgatgtgacgtttagatcctagttgggggttgtgtgacactggggacatgttatgagtggtatatgataacataagatctgtttgaggggcaagttgacataaagagcttgtttaggtggccaaaaggtttccaggatctatttagagggtcttaagatatcaggggtctgttaggggctaagtgacatcagggtgaagtggggaggggaacaaacattagtgaagttgggaagctttcatgagaggactgtcttcttccaatgtgagttatcccctttcgtctaggatgagatcccagcactgtccgtgtcccggccccagaccggcctgtccttcctgggccctgagcctgaggacctggaggacctgtacagccgctacaaggtacattcgacccccaacccagaccttgcacaggacctgacatctcatactcttccccactttccaccactctctggatcagcaagtctggagccatccccttctgtcccctctctgctcgcagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggtgtgctaaggacacctcattcattcatctgtccacttaacaactatttcctaccatgtgctaggcagcagcaaacaaggcagggcagtgcagtgcaatgttcttcagagtattttgactgatcgaaaggtagaaatacatacatatatatatatatacacatatatatatgtatatctatgttttttttgtttgtttgttttttgttttgagacagagttttgctcttgtccaggctggagtgcaatggcatgatctcggctcactgcaacctccacctcccaggttcacacgattctcctgtctcagcctcccaagtagctgggattacaggcatggaccaccaagtctggctaatttttgtattattagtagagacagggtttcaccatgttggccagtctggtcttgaactcctgacctcaggcgatccacccgcctcaccctccgaaagtgttgggattacaggcctgagccccactgcacctggccagaaatgtattttacattgtgattatctgtatctgtctcttactttttagatagatgtgtaaaacataagtttcaccatgaaatatttagccttactaggtgtggtatatgctgatgttttctatcctattctagtctgttttgctttaaacacagttctggtcatgaccttccaaattgatttcacaactactactggtttggggcctgcagtttgaaacgatgagtaggagtgttaagagattgggctctgaggccaggcatggtgcctcacacgtataatcccagtactttgggagactcaggtgggcagatcacttgaggccagaagtttgagaccaggctgggcaacatggcaaaaccccgtctctactgaaaatataaaaattagctgggtgtggtggcacacacttgccatcccagctacgcaggtggttgaggcacaggatctgttgaacccaggaggtggaggttgcagtgagccgagatcgtgacactgtactacagcctgggtgacagagcaacactctgtctaaaaaaaaaaaaaaaaaaaaaaatactgggccctgatagggactcagagtccttatcagagtatattgtagctgctgctgtttatataggtctaggccttgccctcttgatagtcattgtcactggcatcttatctgttttttcttgtttctgggctctgctcctctggaccaagccatgttcttgtaaaggttttggagaaaggtgtgcgattgtgcctggaattggactggtgggctatgaggaagtgaggagagggtggtatccaggatgaggcctttctctttgacctgtgggagttgggatagtgtggctttccctgagatggcaccatgggtagaggagtaggtttgtgggaagacagggagggcagtccagagcacatgggaggtgtccaggaggctgctggtcagccaggtctgacaatcaggagagagactgagcctggaaacagaagtgtgcctcactagtatgagatgcagggggaggcctgctggacagccagggctggatgtcaagagagaatcagggcggtagacaaggagttcgtgtgaatactggggacggacagcaggagggaaggctggaggccgagaggggacccctcagggtctgaaccagagatgttggggtgtggagattaggagggaggaagggggaaggggcagtttccaggctgacacttctcgttttcctctctcccttctcgcaggctccaactattatgtgcgcatcctgagcaccatcgatcgggagctgctcaagcccaacgcctcagtggccctccacaagcacagcaatgcactggtggacgtgctgccccccgaagccgacagcagcatcatgatgctcacctcaggtaaagggggagcctgcagctgggagggccccatggggaccttgaggacctggccaggagccccagctctgctctcccaccagaccagaagccagatgtgatgtacgcggacatcggaggcatggacatccagaagcaggaggtgcgggaggccgtggagctcccgctcacgcatttcgagctctacaagcaggtgaggcggtgcaggtggcagggaagggagaggccccattgggtctggggttggaggtggaacccctgactcccacttctcttccttcctctgggtttcagatcggcatcgatcccccccgaggcgtcctcatgtatggcccacctggctgtgggaagaccatgttggcaaaggcggtggcacatcacacaacaggtgagccctttcgcccctgccccgagctctcatcttctggcctcttcgccttgctccctgctcgctcactggcactgcacagtaattagaaacagactctggggtcatagcccacgtgtgcatgttactggctgtgctgacttcacctccttgggcctctcctagtagttgaagactcatttcacccggtgatagtgagcagttaatgaaataatgcagtgttttcctacaatgggttgtgacctattagtaattatgaatttcaatttgtgggttgcagccagtattttgaaacatgaaatagaacagaaagcgccagagaacatccacatggtatttataccatggtacaagtatatatggtgcaagttcatctgtttcgtgaaacttgtttcatacagatgtgcacactcatgtatacttgtggttcttcaaaaatatatatatatattttaattcttaaatttttttgtagagatagggtctcactctgttgcccaggctggtcttgaactcctgggctcaagggatcctcccacagtgctgggattacaggcgtgagccatgtgcctggccccaaaaatgtatttcttattgtaggtgccagacaaaaatgtctgaaagtcactcactctataacttttttttttttaaagccctaaaatcttaagcatatgttcagatcttaacacatgtgagccagggagcagtaggaggtagtagttaagcagtatgttttctggggctagactgcctggctttgaaatcttactcccccagcaacttcttatgtgatcctgggtaaattaacctctctgtgactcagtttcctcacctgtcagatggaaacaatcatagtacctatttttctagggtgggtgttcagaagagcaaattgatacaaagcatctggaatgggcaataaatgttagctgttgtcattgttactcatttgcttggtactttattgaacttttactctgtaccaagccttgtgctggaatgcaaagatgacaatcagagatgtcccttgccttgactgggaaaaaagaaaaagacacctagaactcagtcattcagtgactgtttattgaacacccactatgtgccaggatgtgttgtagatgctagagacatgggccaggcgcggtggctcacgcctgtaatcccagcactttgggaggccgaggtgggaggatcacgagatcaggagatcgagaccacagtgaaaccccgtctctattaaaaatacaaaaaaattagccaggtgtggtggcggtcgcctgtagtcccagctacttgggaggctgaggcaggagaatggtgtgaacccaggaggcggagcttgcagtgagcccagatcacgccactgtactccagcctgggcgacaaagcaagactccatctccaaaaaaaatatatatatatatatatatatatattaattagctgggcgtggtggccagcgcctgtagtcccagctactcagcgtgaacccgggaggcggagcttgcagtgagccgagatggcgccactgcacttcagcctgggtgacagagtgagactccgtctcaaaaaaaaaaaaaaaaaaaaaagaatagagacgtggcagtaaacagaacacctccttatggaggtgatgtcttagttggaaatgtggcccgacacagattcgtaaagtttcttttttttttttttgagatggagtcttgctctgtcatccaggctggagtgcagtggtgcgatctcggcttactgcacgctctgcctcccaggttcacaccattctcctgcctcagcctcctgagtagctgagactacaggcacccgccaccacgcccggctaattttttgtattttttagtagagacggggtttcaccgtgttagccaggatggtctagatctcctgacctcatgatccgcccgcctgggccttccaaagtgctgtgattacaggcgtgagccaccgcacccagcccgtaaaccttcttaaaacatgagattttttgtgtgtgatttttttttttttttttttttgagacagagtctcactctgtagcccaggctggagtgcagtggtgctatcttggttcactgcaacctctgccttctgggttcaagcgattctcctacctcagcctcccgagtggctggaattacaggtacatgccaccacatctggctaattttttttgtacttttggtagaaatggggttgcaccatgttggccaggcaggtctcgaactcctggcctcaggtgatccacccaccttggcctcccaaaattctgggattacaggcgtgagccactgcacccggctgtgatttttttttttaagctcatcacctatcattagtgttagtgtattttatgtgtggcccaagacagatcttccagtgtggccctgtgtacccttcacccagattccctaatgttactatcttatgtaaccatagtataattaggaaaaccaggaaattaacagtggtacaatacaatgaactaaagtttagacctccttcaaagtttaccagcttttcccactagagaccctcacttcaggttctgtcgtttttctgagtgaattggggtggtttgtcactggcagagggagggaagagagaaggtgtagaagggatgtagaaatgggaaaagctgctgactggggttgagttttgttttgttttctagagacagggtcatgtctggcaaggcgcggtggctcacggctataatctcagcacttcaggaggccgaggtgggcagatcacgaggtcaggagttcgagaccagcctggcaaacatagtgaaaccccatctctactaaaaatacaaaaaaattagccaggcatggtggtgggcgcctgtaatcccagctactcgggaggctgaggcaggagaattgcttgaacccaggaggccaaggttgcagtgagcgaagatcgcaccattgcactccagcccggccaatagtgcgagattctgtttccaaaaaaaaaaagagagatagggtcttgttctgtcacccaggctggagtgcagtggtgtgatcatagcccactgcaaccttaatctcctgggctcaagcaatcctccccacctgtctctcctaagtaggtgggactacaggcgtgtgccaccatgcccaactaatttttgtatcttcattttcagtagagacagggtcttgctatgttgcccaggctggtcttgaactcctgggctcaagccatcctcctgcctcagctccccaaagtgttgggatcacaggtgtgagcctttttttcctcttgtttttcggggggaattcatctatttgttccggtgacagcacagcttactaagagtgagtaactgaagcaggagcccattccaggataggtggaaggagtagtagagcccagggggagctgagagattgggaggacagggaaggttggggtaggaaggggactgtagtgattgagtaggaaaggctgacggacaggctcggtcagataaggcaattccagggatgggggtttcatgtggaactggttggacatttgcagaacagccaagtaaatggccaaagtcaggtggtcaaggtgtgttttctgtttagagcagaaaaagtcagaaatcttgaggttaggatgctgaatgagcccccagctgatgcaagtatcaagaaagagggaccccttgagccaggtgtaaagtctggatcttagggagtgaacagggcagggctgaagccttgaacagttcctagcttatgacataaaaccactcagtctatctatggactgcatgtctcccttctctggtggctggaaggagagtcctgggggtatgcttcatacaacacaaagcatctgatccttaagaaacaagtgtaactttaagaaacaaggccagggtcaagcatggggtggctcatgtctataatcccagcactttggaaggctaagccaggaggatcgcttgaggccaggagtttgagaccagcctgagcaatatagcaagaccccatctcctcaaaaattttaaaaagctaggtgtggggacatgcctatagtcctagctactcgggaggctgaagagggaggattgcttgagcccaggagattgaggctgcagtaagctatgatgataccactgtactccaagtccaaagggagggcccagaacaaatctgtcttcaaccccattgccaattgtcagttatatcagaacatgcccgtggtccctgatctttttcaggaaattaaaaagctggtccttatagcaaacaggaactcagagctcttggcgaggcagtatgatgtcttagtgtatgggcagcatgcctgttttcttgctgattttgcaagtgctccagaaatgtagactggtttttttctttcttattttagtatttcatatcctgatttttaaatgttgggccaaaaaaatgacacatctggctggacatggtggctcatgcctgtaatcccagaactttgggaggctaaggcgggcagatcacttgaggtcaagagttcaagaccagcttggccaacatggtgaaacctcgtctctactaaaaatacaaaaattagcttggcatggcagtgcacgcctgtaattccagctactcgggaggctgaagcaggagaatcacttgaaccctgaaggcagaagttgtggtgagccgagattgtgctactgcactccagcctgggcgacagagcaagactctgtctccaaaaaaaaaaaaaaagtgacacatttgtaaggatgattcatgatttaggccactgggtcactgtggggtacaagtagatggctattcctcagggctggatgtggggctcacccttgggcatgagggaatgacacaactactaggtatgggtatccaaggaaaaggatgtcttcaaggaattcgcagtttctgttaaagcagaatgggcccctcaggaggctcattcccgcctaactgttgtcatcctgtcatcagctgcattcatccgggtcgtgggctcggagtttgtacagaagtatctgggtgagggcccccgcatggtccgggatgtgttccgcctggccaaggagaatgcacctgccatcatcttcatagacgagattgatgccatcgccaccaagagattcgatgctcagacagggggtaagtgatgctgaaacaaggcccggggtcttggacaggcttgtcgcatgggatgcctgggactgactgtgctgtgcactctcagccgacagggaggttcagaggatcctgctggagctgctgaatcagatggatggatttgatcagaatgtcaatgtcaaggtttggggtttgggatggacaaggggaggtgtggtgtaggaactggggaaagttgggggctggcacctaaggggtggttatcgtgacaggaaggaggtaggagtgcagagatctgagctggcctgccccccaatgtcaggtaatcatggccacaaacagagcagacaccctggatccggccctgctacggccaggacggctggaccgtaaaattgaatttccacttcctgaccgccgccagaagagattgattttctccactatcactagcaagatgaacctctctgaggaggttgacttggaagactgtatcctgctccagaagtcagggaggggccctagttgggaacggggattagatcttcagctcaacttctgccagcaccacagcccagactgtgcaggtgggaccaaggtccagggaggaggggaggtgacagagatggccaaagatgacttccagccccaggcatttaccccatcacacagggaatagtttccttaactcgctgcagatgtggcccggccagataagatttcaggagctgatattaactccatctgtcaggaggtaagtggtggtttctctctggatccaggcagcgggtgtgtgaggacccttcttctctgaaccactctgctgcagtcctgtcccctcatggctgccctgggtcgtgggcgccatctctctcttcctctaccatcactaggggtggatagtacaggggtagtgtttttgtgttttgctttgagacagggactcactctgtcgcccaggctggagtgcagtggggcaatcatgactcactgcagtgatcctcccacctcagcctcccaagtagctgggattacaggcgcccaccaccagtctggctaatttttgtattttttgtagagacagggtttcaccatgttgcccaggctggtctcgaactcttgggctcaagtgatctgtatacctcagcctcccaaagtgtcgggattacaggtgtgagccactgtgccctgccacaggaagtagattttaactctcatccttcaacagagtggaatgttggctgtccgtgaaaaccgctacattgtcctggccaaggacttcgagaaagcatacaagactgtcatcaagaaggacgagcaggagcatgagttttacaagtgacccttcccttccctccaccacaccactcaggggctggggcttctctcgcacccccagcacctctgtcccaaaacctcattcccttttttctttacccaggattggtttcttcaataaatagataagatcgaatccatttaatttcttcttagaagtttaactcctttggagaatgtgggccttgaataggatcctctgggtccctcttaatctgacagatgagcagacgaggtgcatggcctgggttgcagcttgagagaaccaaaatattcaaaccagatgacttccaaaatgtggggaaagggatggaaaatgaacctgagatggagtccttaatcacgggataaagccctgtgcatctccctcatttcctacaggtaaaagacagtaaagaaattcaggtcacaggccttgggagttcataggaaggagatgtccagtgctgtccagtagaactttgcacaatgatggatatgttctgtgttctccagtatggtagctgctcgccacatgtggctaataagtacctgaaatatggctagcatgactgagaaactgaactttttttttttttttttttttttttttttttgagatggagtcttgctctgtcacccaggctggagtgcagtggtgagatcttggctcactgcagcctctgcctcccaggttcaagtgattctcctgcctcagcctcccgagtagctgggaccacaggcatctgccaccacacccggctaaattttgtatttctagtagagacagggtttcactatattggctaggctggtctcgaactcctgacctcaaatgatctgcctgccttggcctccctaagttgttgggattacaggcgtgagccactgtgcctggtcaagaaatggaactcttacacactgctggtgggaatgtgaaatggtaagccacttcggaaaacagtttgacaatttcttatgctaaaaatacacctatcagatgatttagccacttctaggtatttacttaagaaaaaataaggcatacatccatatgaagacttgtaaataaatgttctcattatttttatttgaaatagctaaaactggaaacaacccaaatatccatcagcaagtgaatggataaacaaattgtaatatttgtatgcaatataacaccactcagtaatatgaaaatgaactactgatgtatgcaaaaacgtgaaattcaaaataattatgctgagtgacagaatccagacaacaaataatacataatgtattattctatttacataaagttttagaaaatccaaactaatctaagtaacaaagcataccaatggtatatggggcttggggcaggtgagacggattatagagaaaaaagtaggaggtgatagacatgtttagtttttttgcttgtttgtttttactgtggtaatggtttttcaagtgtgtatgtcaaaacttatcaaattgtacctaatttattgtagttttattgatacctcaataaaattaatagttacatacataaatgtacttgaagttccacctagcacaataaggtaagaaaaaaaattaaggcgtgggactggaaaagaaatgaaactcttcattattcacaaatgtcatgattgcatatatggaaaatctaagtctacacaaaacctattaaaattaaatagtgaatttagcaatgtggctaaacaaaggtcaatataaaatattaaatataagccaggcatggtgacatgcatccacagtcccagctactcaggaggctgaggcaggagaattgcttgagcccgggagttcaagtccagcctgggcaacacagcaagacccactgtctctgaaaaaaaatcaaatacatatatcagcaataaataaataggaaattaaattttaaattataacatttatcaaataaattcttaagtgccaagaataaatttaaaatatgagatataaatagttaaaattacagaatattgacagaaatcaaagaagacaaataaatgttgggatacaacatgttaatgtattggaagattacgagtaaaaatattaattctccacaaattgatctataaacaacgcagcgccaatcagaatcccagcagttttgtcctgctggaaactgacaaactgattctgaaatatataagtaaatgaaaggctcagaaatagccaagagaatatttgaagaaaaaagcaaagctggaagacttacaataccaaatatccagactgatggtaaagctgttgtaactaatgtagtgtggtatggccttaccaatggacaaatcaatggaacaaaatatggagtccaaaaagaaaataatatactcacttgatttctgacaaagttaatcctgtggtacactggagtatgagtgatcttttattaaatgttgccttgtcaactctatgtagataaaataaatctgtgttaccagatgaagagtttttaattgggttgttcaggttattggcatgttgaacaaagaactgaacaaaatgcacagacaaagaaaaagcaacaaaagcagagatttattgaagtgaaagtacactccacagagttagagagggctcaaacaagtggctcaaaagtccagattataatgttccttggggattttattaaactaaaagagcatagtagcacgcctaaacgtcctttagaagcctctaacaggtcatactctataggaatgaagaattctgcccaggaccaatcagaggcaccctgcaaatgagggattcagaatgaaccaatcacaggcattcccattgtgacacaggggaggggaggttcagagaaggagggcctttggcctcgttatttggtcacggagaggtgaggttttcctcttagtccaattccaagaagtcagcaggggttggccttaggttccctgtctccagactctattctcctgcctcatttggacccctacaatctaattgtgaatgtaaaaggtaaaaaaagtttcaaataattacgtagaaggatagcttcatgacctttggtttggcaatattaatcattttttaaaatagtttttttgtttgtttgtttgtttttgaaacagagtctcactctgtggcccaggctggagtgcagtggcgcaatctcggttcactgcaacttccgcctcccaggttcaagcacttctcctgcctcagcctcctaagtagctgggataacaggcgtgtgccaccacacccagctaatttttgtatttttagtagagacggggtttcacctgacctcatgatccgaccaccttgccctcccaaagtgctgggattacaggcataagccactgcacctggctggtggcacacattctttttttttttttttttttaaagacggagtttcactcttgttgcccaggctggagtgcaatggcacgatctcagctcaccacaacctccgcctcctgggttcaagtgattctcctgcctcaacctcccgagtagctgggattacaggcaggcgccaccacgcccaactaattttgtatttttagtagagagagggtttctccatgttggtcaggcctgtctccaactcccaatctcaggtgatccacctgcctcagcctcctgaagtgctgggattacaggcattagccatcgcgcccagccacacattcttatacaaacagttttaacttggttgtaaatatctccactcaaaggatctggcccatgcagaaacacaagacttgtccctcaatataaatcgtaagataggtggtgttttgtacagtctagaaaaccaggccaagttgcagcaaacccctaggttttaatgttaataaagtcctcttggacttcatgggcccaaaagttccagtgttgtattgcttttgtaagaaaatttcaaaactgtaaaaaagacaaatgggtagttcttggaataccaaataagtagtggttaaactggaggtatcagtgcatagctaaggcactaaatttgttataggtcagaatcaactccctaaaatttgatgctcatagccatgaaataaggtggtagagcaatgcaggttccctgatcaaacagcctttcaaaaggagtcttgatcttattcaaagatcatgtcatttaatttgcactatggcctttgccacacataaattatgcagtaattccagtattccactaaaaatccatgacctgaatctcattatgggaatacatcaaactacaaaattgagagacattatataaagtaacaacttttttcttcaaaaatgttgtcataagaaacaaagaaagggtagtaatatcacatgatatcaaagtaggggattcttgctcccttcctcccacaaaagtggacaattagctatccatgaataaaaatagctctaggagagctctggaatccagttaagaagctgcagcaacacagtggagcaaaaaaacacctagaataaccaacataaggggcaggaagaacagtttcatttttaaaaattgaaatcatatcaagtatcttctgagatcacaatagaaaaaaatccctaaaaatcagtaagaagcagaactttggaaactgtataagtacatggaaattaagctcctcaatgaccactgggtcaaggaagaaataaaggaggaagtaaatttcttgaaacaaatgaaaatagaaacacaacataccaaaatgtgcgggatacaggaaaagcagtgctaagaagaaagtttatagcaataaatgcctacatcaaaaaagtagaaaattttaaactatcgaatcatgcaccttaaggaactacagagcaagaacaaaccacacccaaattagtacaaagaaagacataataaagatcagaaaattactaaacaaaatagagactcaaaaaaatacaaaggattaacaaaatgaaaagttggttcttggaaaagataaatagaattaataaaccactagctagactaaccaagaaaaaataaaagaaccaaataaacaaaaccagaagtgtattataactgataccacagaaataccaaagatcatcagagactacagtgaataactatacactaacaaactggaaaacctaggggaaatggataaattcctggatacatataatttactcagattaaatcagggagaaatacaaaacctgaacagaccaataatgtgtaagaccaataatgattcaaatatattgaatcagtaattaaaagtctcccaacaaagaaaaagtccaggacttggtgcttcactgcaaattctaccaaactttcgaagaactaacaccaattctcaaactattcccaaaaattgaagagaagggattctccctagctcattctaagaggccagcattaccttgagaccaaaaccagacaaggatgcaacaactacaaaaaactagaagccaatatccctgatgaacatagatgcaaaaattctcaacaaaatactagccaaatccaacagcacatcagaaaggtaatacaccatgaccaaatgggatttatcccaggaatgcaaggatagttcaacatattcaaatcaataaatgtgatacatcacataacagaatgaaggaaaaaagccatatgatcacctcaatagatttcaaagcacttgatgaaaataaacatcctttcaagataaaaactctcatcaaactaggcatagaaggaacaaacctcaacaaagtaagggccatatatgacaaacccacagctaatatactgaatgaggaaaagccaaaaggctttcctctaagaattggaacaagacaaacatgcccactttcaccactcctattcagcacagtactggaagtcctagccagattaatcaggcaagataaataaataaaagacatccaaattggaaaggagaaaatcaaactgtccctctttaccaatgatatgctcttatttctaggaaaaactaaagaatccacaaaaaactcttagatctgatgtagccaaaaaaccaataggaaagcaatcctgaacaaaaacaacaaagctgaaggcatcacactacctgacttcaaaatatattacaaggctatgataaccaaaacagtatggtgttggtataaaaccagacacacagaccagtggaacagaatagagaacccagaaatgaatctgtgcatttataaccaactgattttcaacaagggcaccaagaacatgtacaggggaaaggataccctcctgaatacatggtgctaggaatattggatatgcatatgcagaagaatgaaattggaccccaatctaccatatacaaaaatcaactgaaaatggattaaatggattaaaaacttaaatggcagacccaaactataaaactatgaagagaaaacaagggaaatacttcaggacattggtctaggcaaaaattttatggcttagaactcaaaagcataggtaacaaaaacaaaaatacacaaatgggactatattatggtaaaaagcttgtgcatcacaaaggaaacaacagagtaaagaggtaacctgttgaatgggagaaaatttttgcaaactattaatctgacaagggactgatatccagaataaaaaaggaacttacacaacagtaaaacaaaacaaaacaacccaaccaaaaaaaatcctattaaaaagcaggcaaagtacatgaatagacatttctcaaaagaagacataaaaatggccaacgggaatagaaaaaaaaaaaagcccaacattaataatcatcaggaaaatgcaaatcaaaaccagaatgagatatcatcttagcccagttagaatgaccattactaaaaagataaaaaataatagatgctgttgaggatgtagagaacagggaattttttttttttttttttgaggcggagtctcactctgtggcccatgctggagtgcagtggcatgatctcagctcactgcaacctctgtctcccatttcaagcaattctcctgtatcagcctctccagtagctgggactacaggtgcacaccaccacgcctggctaatttttgtaattttagtagagacagggtttcaccactcttacacactcttggtggagatttaaattagtacatctcctgtggaaaagaatgtggaaatttttcaaaaaactaaaaactaccatatgatccagcaataccactactgggtatctactcaaaggaaaaaaaatcagtatattaaagggataccttaaatcccatgtttattgcagccctattcacaatagcaaaatatggaatcaccctgcgtccatcaatagatgaatgaataaatgaaatgtgatagccgggcacagctgctcacacctgtaatcccagcactttgggaggccaaggtgggtggatcacaaggtcgggagttcaagaccagcctgaccaatatgttgaaaccccatctctactaaaaatacaaaacttagccgggcgcagtggcaggtgcctgtaatcccagctactcaggaggctgaggcaggagaatcacttgaacctggggggcagaggttgtaatgagccaccactgtactccagcctgggtaacagagggagactctgtctcataaataaataaataaataaaatgtgatatgtatacataatggaatactatttgaccataaaaaagaatgaaataatgttatttgcagcaatgtagagggaactggaggtcattaagtgaaataagccaggcacagaaagacacatatcacatattctcactcacatttgggagatgtaaaaaaaaagtcactcatggaggtatacagtagaacaataatactagatgctaggaggagtgtttgtgaggggatgaagaaagactgggtacacaacacacagttagaaggaataagctctaatgttcaatagcagagtagagagatcacaattaacaatgtatatttcaaaatagctagaagagaggacttgaaatgttcccaatacacataaatgataaatactcgaggtgatggataccccaaataccctgacttgagcatcccacagtctatgaatgtaagaaaatgtcacatctggctggatgcagtggctcatgcctgtaatcccaacactttgggaggctgagcggggaggatcacttgagcccaggagtttgagaccagcctgggcaacaaaatgagacccccgtttctatttacatttttttaaaaagaaaatatcacatgttccccatgaatatgtataaacattatcaatataaaaatatttaaaaaaattttaaagacacataggctaaaagtgaagggatggaagaaattattctatgcaactggtaaccaaagagagcagggtggctataattatatcagacaaaatagactttatgttgaaactgttattagagacagaaaaggtcattatataataataaaagggtctattcaacaggaagacataaagattgtaaatatatacgcacccaacatcagagcactgaaatacataaaacaaatattgacagagctaaagggagaaattgacagcaatgctatcataggaggaaactttaatgcctcaatttcaataatgaatagagcactcaagcagaaaatcaatttttaaaaacccgacttgtgcactctagcctaatggaccccacaaacatatctataactttccacccagcagaagaagaattagcccatgcaacaaattcttttcaaacacacttggaatatcctccaggacagatcacatgttgggtcacaaaacaagtcttaagaatttaagaagattgaaatcataccaattatctcctcagaccatgtggaatcaaactagaaataataacagcaataaataaggaaaatccacaaacacatagtaactaaacaacacacttttgaacaccagttgggtgaaagaggaaatcaaaaaggaatttaaaaaataccttgagacaaatgaaaacaagaatacaacataccaaaatttatgggatgcagcaaaagcagtcctaagagaaatgtttatagggataaatgtctacatttaaaaagaagaaatatctcaaacaacctaagtttacaactcgaggaagtagaaaaaaaaactaaaagcaaagctagcagaaagaaaaaaaataataaagattagaatggaaataaatggaataggctgggcacagtggctcactcctgtaatcccgacagtttgggaggccgaggtgggcagatcacttgaggtcaggagttcaagaccagcccggccaacatggtgaaaccctgtctttactaaaaatacaaaaattagctggttgtggtggtgggcgactgtaatcccagctactcaggaggctgaggaagaactgcttgaacccaggaggtggaggttgcagtgagccaatctcgccatgcactccagcctcagcgatagagcaagactccatctcaaaaaaaaagaaataaaatagagagcagaaaaaccataaagaaaaatcagcaaaactaacagttgtgtttttgttaaagataagcaaaatcaacaatcccttacgtagactaagaaaaaaaatagagaagactcaaagaaaatcagaaatgaaataggagacattaccttgaatgacaaagaaataaaaatgatcataagtgactattataaacaagtatacatcaacaaattagaaaatatagtacagtggcccccaacctttttggcaccagggactggtttcatggaagacaatttttccacagaccagggtgataaggggacaggggaggatggtttcaggatgaaactgttccacctcagatcatcagattctcataaggagcgggcaacctagatcccttgcatgcagagttcactatagggttcatgctcctgagaatctaatgctgccactgatctgacaggaagtggagctcaggcagtaatgttcgctctcctcctgctgtgcagcccagttcctaacaggccatggactggtactggtccatggcccagggattgtgaacccggatataggagaaatagataaattcctagaaacatacaactttccaagatggaatccggaagaaataaaaagtcttacttctcctgggacccctggaatcatggcatattctgaacaaggggagaaacatattgagcagaggctcttagaggagaaaccacctggaatgactcatgagaagatggcatctggagtagaggctattactggcccaatacagaacactgttcactgggacttcccttacaccagcatccagtatgctcccacccccatgcacccttcggaggtgcatgctcagcaaggggtataagagtaccactggcaaaacaatgcttaatccatctggcagtcatcctggccctgtgttttcctacatcagggctaaaggaggccaaggggtggcagagtgtcagaactgattcattattccaaagtgcacttttgcctcactttcgaggcattgagactttgctgtggacagtcttatactgtctcctcgcagggcatggccttctctgtgccttgtccttgttatgcatcctcctgtatccctcacaaaggaagagatggagctgtttgctaatccactttcttcttgagcagttcatgttgtatgaataatagcaaaacctctaggtcacatgtgacttgtttaaatactgtacatacataccttggtgtgtgtgtatatatatatatacacacacacacacacacacacatatatacatatacatatatatatatatatatatatatataaaatacacacttgtacatgaaactcgtagaattcaaaccacatcccatatgggctctgaatatcctaggtagtgcttggtgcaagagagaagtttgttggcatataattcaccttatcacccctgtctctttgtcataattctgctaaattattgagcctccatcacatccagtttcttatggacattctagtctcactcagaactgactcaaagttcgacacacactttttaaaaattcctcctaattgaaactgtatatcctttgaccaacatctctccaaccaacaccacccctgacaggccctggtaaccacaattctacgctctacttctatgagttcaacttttttagattccacatataagtgagattacacagtatttgtctttctatgcctggcttacttcacttaacataatgttctccaggttcatccttgttgcaaacaacatgatttcctcctttttaaagtctgaatactattccattatatatatgccatttcctttctccactcatcctttgatgaacacttagattgcttccacatcttgactattgtgaatagcgctgcattaaacatgggagcatagatatctcttaaacatattgattttatttcctttggatattgatatagtttaaatgtgtgtccctgcccaaatctcatattgaaatgtaatccccaatgttggaggtggggcctggtgggaggtgattggatcatgagggtggagtcctcatgaatgatttagcaccatccctcttagtaccatcctcccaatagtgagttctcatgagatctggttgtttaaaagtgtatagcacctccccctcactctcttgctcccgcttttgacatatgacatgcctactccccctctgccttccactatgactggaaacttcctgaggcctccccagaagcaggtgccattatacttcctgtacagcctgcagaactgtgagccaattaaacctctttacttagaaattgcctagtctcaggtatttctttatagcaattcgagaatggactaacagaaaattggtaccgagaagttgggcattgctgtaaagatgcctgaaaatgtggaagcagctttggaattggataacaggcaaaggttggaagagagttgagtgctcagaagataggaagatgaaggaaagtttggagcttcttagagactggttaaatggttgtgactaaaatgctgatagtgataacggacaatgaagtccaggctgccaaggtctcagatagaaattaggaacttattgggaactggagaaaaggtcccttttgctatgccttagcaaagagcttggctgcattgtgtccacaccctagggatctacggaagtttgaacttgagagtgatgacctagggtatctggcagaagaaatgcctaaataacaaagcattcaagatatggcctggctgcttgtaaccacctatgctaagatgtgggagcaaagaaatgacttaaagctggaacttatatgtaaaaggtaagcagagtgtaaaagtttggaaactttgcactggccatgtggtagaaaagaaaagttcattttcagaagaattcaagaaagtttctgagcaaccatttgctagagaaatttgcctaactaaaaatgaggcaagtgcagatagccaagaaatgggaaacaggcctctaaggcatttcagagatctaagaggcagcccctcccatcacaagccccgaggcctaggaggacagaatggtttcatgggccagaattgacctgtgcagcctcaggacatgtctccctgcatcctggcttctccaactccagctgtgacttaaaagggcccaggtacagctcagactgcagctccaaaggttgcaagccataagtcttggtggtttccacatggtcttaagcctgcaggtgcacagagtgtgaataaggcttgggagcctccatctagatttcagaggatatgtggaaaagccaaggtgtccaggcagaagcctgctgcaggggctaagccttgacagaaaacctctactagagcagtgcaaaaaggaaatgtggggttggaaccctcacacagagtacacactggggcactgactagtggagctatgagaagagggccaccatcttccagatcccagaatggtagatcagagcagcctctgagcctgaacccggcaaagccacaggggaagaaatacccaaggctggaagcccacctcttaaattggtgtgccctggacatgggacatggaatcaaagattattctggagctttaagatgtaatgattgccctactgggttctgatcttgcatagggcctgtagcctctttcttttagccaatttctcccttttggaacaggaatgtctatctaatgcttgtacccccattttatcttggaagtaactaacttgtttttgatcttacaggctcataggaggaaagaacttgccttgtctcagatgagacttcagactttggacttttgagttaatgctggaattagttaagactctgggggactgctgggaaggcaagattgtattttgaaatgtgagaaggccaggagatttgagaggggccagaggcagaatgacattgtttagatgtgtatcccaacccaaatctcatactgaaatgtaatccccaatataagaagtggggactggtgggaggtgattggatcatgggcgcagattcctcatgaatggcttagcagccctttgtttccatcctcataatagtgagttcttatgagatctggacatttaaacgtgtgtaccatctccctcctcactctcttgctcctgctttcaccatgtgatgtgcctgctcccattttgccttccaccatgattggaaacttcctgaggcctgctcaaaagcagatgccactatgcttcccgtacagcctgcagaactgtgagccaattcaacatcttttcttataagttaccgagtctcgggttttctttatagcaatgcaagaatggactgatacggatatatacagatatatacagatatatatagtgggatgactgggtcatatagtggttatatttttaatttgagaaaactccggatattttctatgtttgtactaatttacatttccacaaatagtgtacaagtgttcccttatatccataccctcaccaacccttgtcgtcttttgtctctttgattacagctattctaacactgtgaggtggtatctcagtgtggttttaatttgcatttctctgatgattagtaatgttgagcattttttcatatggacactttttttttttttttttaaagatggagtctcactctgtcacccaggctggagtgcagtggcgcgatctaggctcactgcaaccttcgcctcctgggttcaagcaattctcctgcctcagcctcctgagtggctgggattacaggacccaccacgcaccaccacacccagctaatttttgtatttttttagtagagacagggtttcaccacgttggtcaggctggtctcaaactcctgacctcacgatccgcccacctcggcctcccaaagtgctgggattataggcataagccaccgtgcccagccttatattgacacatttttaagggatttgggggggggcaggggttctttgcaacaatgtaaacatccagtccctcatcaaactttcaattttttttcacgtactaatttatatcagtttggaattatgattccctctgttatttaatgggttttaatctataactagcattatttattttgatgctcaaaccatgtcaagtttggtcagtggaagtcccttcaatctggtttccatgtcctttgaacacgtccccaccattctttgagcactgccttactttcaagcacaagatgttccaagttcattctgaactttcccttccccagctctggaatctgccatttctccatggagccttgctcctttcagtggagcatggtatttaggaaccaagggctgactgcctaatgtgctttccaagtataatttcctcagtccaagcttttcaaattgatctgccaaagacccattgccaaagatccattgccagaatataagagtggaaggaaattcttaatattttttgaaagttactattattttcatttttctctttgtaaaaaattcatttaattcaatataaaaagacaaaaatctttggcacataaatcgcaactctctgatgcaaatgtttaaataaagctgatactccaagaagacgcaacatattctctttatcccacagacatataggcctatggttgcaaacttttatacacacacagagtcacaattccactggcacccgtgatgttccacatccagattttccaaatcacacattctcatcttcacatagccttgccggcaaccacacggcatagtaccacattgttacgtcaagcacagccagtctaccacagagcctgtcgtcccattgaccaaagtcacaaaaatcacagccccgggtatttactgtggttttctccagtcagatcccttcactcactacacactgactcacactcaaattacacacacgcggaaacacaacccgccagagccagagaggttccgtcggtcccgcaaccctcacagtgccacacacacgcgctcacaaggcaaatacaaatggccaggcactcattctttacaatacacatattaagcgcctattatgtactacacgccgggactacctcaagaggtgaaacaaacaaaatcctgcctggcggagctatcgcccagtcccgcacgcactcggcctcagggtcacactcggcggtcccacgctcaagtggcccggccagtggcccagaggcgtctgttctcctcctcagcttcctgcgtgggttcctggtaagtgagtcgaacccgccggatgcgcgcgcgcctgcgcctccgcccaaaaggatcagtttccggctgtggactacatttcccagaagccccttgggcagtgttgcctggaccccaagggccctttacattgcgttcttaacggttcagtcaccttaaccgttattattcacttgcgggcgagaagtccgagctaggtgaggcggaacgggactcttacgagtaggactggggatagaactgccgcccaaagtgaggcgctccagggcccagacctggcgtgtcgtgcccgcagggagcctcaggcctgtgcgtgcttggggagcggagaagggaaattgtgtgacaaaatgtggcagacggtgtatgtgtgtgtgtgcgcgcgacggggcgcctgtcaggaccgggttgggcgggtgtgggtgcgggtgtgaggctgagacaggtgcctggctctctggtgtgtgtcactgaccctctaccctcctcacggcctcggtgtttgcacacagcagtgtccccaagagggaagtcaaatatcgagctctgggatgaaggttcccagcaagaaggtacagacctgggttggcgattggacttttgaattagaagtgtccctaaaacagactcctgggacgacaggttggaagactgcgcagttggagccgctgtgtgggcagctgcatgtttcagaaccactgcattcccatacctttgatctagaaacctggtgtgagttcagagacagatcccagcctcactctcacacagctgttatgtgcgtgaggtcagcacagatgtggcgctggaggggatattctaggtcggtctgtgctcttaagaaaggcctgctgtctcatgattatttttcttcccccattctgctattcatcaaaacagggatcctgaaaaggagggaacaattgttgtagcaggtctaaaagttcaggtccaggtaagtttatatttcctttttattcataaaatggaaatcacacattctaatcctcacacagccttgcctgcacccagtcatacggcgtggtaccacactgctatgtcaagcacagccacaatctaccacagagcctgtcacctcattgctcacagtcacaaaaatcacatccccaggtactttctgtagctttcatttgcatttttccctttgaagaagttcatttgattcaatctaaaaagactaaattatttgtcacataaattgcaactctctggtctatatctttaagtaaatctttaaataaatgcataaaatgtttttgtttttaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatggtagagaaatgcatatcctggagtctaaagttaaaactttgttttattgagattaatgtttaggtagaatcacatcatccatcttctccaatcttctccaaagacctcagttttaaaatatgacaggattagagatgacctgactagtgtcagtaagcaagtgataatggtcgcctgcttttaaggcttttagaagtgggaatgtgattggaagtccaagcatagaaatctgtgtgaacatgagcagggatttttttccaaggaatccatgagttgagatttatttttatacagagttagtcataagaataaaaagtacatatgagtaaagtaatagtcatagtgatgaagaataatacgcaatttttttttctttttttgagaaggagtctcgctgtgtcacccaggctggagtgcaatggcatgaactcggcttactgcagcctctgcctcctgggttcaagtgattctcctgcctcagcctcccaggtagctgggattacaggcgcctgccaccatgcctggctaatttttgtatttttagtcgagacagggtttcaccacgttggccacgctggtctggaactcctgacctcaggtgattcacttgccttggcctcccaaagtgctgggattacaggcatgaaccaccgcacccagccgcaaattttaaattttatatgaatctcactaatattaggatttaaagacatttaacaagcattatatctaaattaacatttcaactgattatttgctggagaagtagaggagaaccaaacactcttctgtctgctttgttcaaattttcttattcagtctgcagacactgttcacctggcttgtgtattaagagaagaatcttaacagtgaaaaggtcttgttgaattgaagaagaatgttcaagaactggcaggcatttatttataatggtcatgctgttttcctattgtttgcatacatgtcaaaccaatttgcttctgatgtgttaaaacattttattttataattggatatagatctattgtatacttctggttatagaattaatattcaccttttataaattatttagttactcattatattacataaggcacttataaagaagaaagttaaaatagccccagcatcactattaacactttggggagctatattttagcaagatttttttttttttttgacagagtctcgttctgttgcccaggctggagtgcagtgatgtgatcttggcttactgcaacctccatctcccaggttcaagaaattctcctgcctcagcctcccgagtagctgggattacaggcgcctgctaccacgcccagctaattttttgtatttttaatagagatggggtttcgccatgttggccaagctggtctcaaactcctgacctcaggtgatccacccacctcggcctcccaaagtgctgggattacaggtgtgagccaccatgcccgacctatttcagcaagatttttcagcacacttgtatgtatgtgtgtgtgtatgtgtgtgcgcacagcacctgcacttttcttcctgcagaatagaaattgcactaactgattattcaaaggacacaagactttccagcttctagttagaaaaactaattctccctaaccatagctttcttataactctgtgcacatagggagaagaggaaaacaccaatgaatcctgctaagtttgattaacctttgagaaatttacaccttttagggttatataaaccaatcaaggataattaatatgacataatttatcaagtaagatagttcttcaggattatactctttttttagatttttaaggttgcttttacaggacatagcaatactcttatcttggttaggtttttttcagggttccattatgcaaataacattttctaggacagatttataacagtagaaaacagaataagggtgggcatggtggctcaagcctgtaatcccagcactttgggaggcccaggcaggtggatcacgaggtcaggagttcaagaccagcctggacaagatggtggaaccccatctctactaaaaatacgaaaattagccggctgtggtggcatgcgcttgtaatcccagctgcttgggaggctgaggcagagaattgcttgaacccaggaggttgcagtgagccgagatagcaccactgccctccaggctgggcgacagagtgagactctgtctcaaaaaaaaaaaaaaaaaagaaaaagaaaaagaaaacagaataagatagtaacagctacaaatattcatgtaaatctttccatatagaacaggagaacaagattgaacctcatattaaaattatctattgaatgccttattacagcagttcccaacctttttggcaccaggactggtttcatggaggaccgttttttcacagacagggagagggagatggtttcaggatgattcaagcacattacatttattgtgcattttattcccattattattacattataacacgtaattaaataattatacaactcaccctaatgtggaatcagtgggagacctgagcttgttttcctgcaactagatggtctcatcttggggtgatgggaggcaatgacagatcatcaggcattagattctcataaggagcacgcagcctagatccctcacatggtcagttcataatagggttcgcactcctatgaaaatctaatgctgcagctgatctgacaggaggcagagatcaagcggttaatgctagcaatggggagtagctgtaaatacagatgaagcttcccttgctggcctgctgctcaccttctgctgtgtggcacagttcctaacaggccgtggtccagtgtcagtcagtgacctgggggttggggacccctgccttaattagattattttagctagttttatgttgaagaatgatgtcccccctttggtagttgcaagaacaaaagaggatatttcttttttttttttttaaatgaagtctcactctgttgccctggctggagtgctgtggctcaatctcagctcattgcaacctctgcctcccaggttcaagtaattcttctgcccagcctccagagtagctgggattacaggtacccactaccacacctggctaatttttgtatttttagtagagacggggtttcaccatgttggtcaggctggtcttgaactcctgacctcaggtgatccacccacctcagcctcccaaagtgctgggattacaagtgtgagccaccgcgctctaccaagaagagatttcttgattatctttctgggagtctgttttacgaatgttgttaattaaaaataattgcatcttcaaggctcagctctgaaatacttaaaatatcattattaaaaaatgggcatgagactcaaactttactagaaaaaatgaaataatataaaatgattttatttaatagcagtggaacaaaggacataatatcctctattttaataatactggctaacttttattacgtaattatgtatcattaagtgggatgtatgtattatctcaatcttcgtgacaaccctatgagataggtgctgtttttatccctaatttaccaacaaactaactgaaaagtatgtagctgtcagactaagattcacattctgaaaatctgacaacagagtttgtgttattaatgacaacgttataaccctgcccataatggcatatgctcctttaatttgcctgtatcagtcagtaactcatcattgatgtcttcctccaaaaataaatatggaccaatatagttagtattagtaaggccttagtgtgccatcataactgaccatagtttatttaacctgctgcctactatagctattagtatttttaatatttgattattataagttgttatatgataaatgtcttatgtatatgtcttaatatgctttaatagccacttgcaagaaaaaaatgccaaaaattggaattttagtcaaatatcagacataagggctcacagtatactgaatcttgtgttagtaatcagaggaatacaagaactgaaaacacataggtgttactgtacagcagagagtctaaaatcagaatagactgaataagtataaggtagaagataataaaaaacagtaaagaaattcaggtcacaggccttgggagttcataggaaggagatgtccagtgctgtccaatagaactttccatgatgatggatttgttctatgttttccagtgtggtagctgctcaccacatgtggctaataagcacctgaaatatggctagtgtgactgggaaactaacttttttttttttttttgtcgagatagagtctcactctgtcgcccaggctggagtacagtggcgagatctcagctcacagcagcctctgcctcccgggtggaagcgattttcctgcctcagcttcctgattagctgggaccacaggcatcagccaccatgcccagctaatttttgtatttttagtagagacaggggttcactatattggccaggctggtctcaaactcctgacctcaaaagatccgcccaccttggcctcccaaagtcctgggattgcaggcgtgagccgccgtgcccggcctgaacttttaattttatttaaaatttgatttaacttttttttttttttttttttgagacagagtctcgctctgtcgcccaggctggagtgcagtggtgcaatctcggctcactgcaagctctgcctcccaggttcacaccattctcctacctcagcctcccgagtagctgggactacaggcgcctgccaccacgcctggctaattttttttgtatttttagtagagacggggtttcacgttgttagccaggatgatcttgatctactgacctcgtgatctgcctgcctcggcctcccaaagtgctgggattacaggcgtgagccaccgtgcccagcttaaaatttgatttaaataaccatatttgtattgaacagcacaatttcataccttaagtttttattgtaatgattcaaagtgaggctaatgggtttttattgttagattcaaaaacaaagtttttattgttagattcaaagtgaggctaatgggacaagattattcagcagcagtttggaggatattgtggctgaaaggaaaatttcagagcacaaactgtcaatacgtttgtcaggagtacatgaaaagccacttcactgtgaccagcattcatatgtataagacattgcaatatattagcatacatggacatatgtgaaaaatcaaaagaattgcttccaatgttatgagctaaagggaaaaaagacattcagtaaaaatataacagctgttggccaggcacagtggctcatgcctgcaataccagcactttgggaggctgaagagggcagatcacctgaggtcaggagttcgaaaccagcctggccaacatggcgaaaccctgtctctactaaaaataccaaaattagccgggcgcagtggtgggcgcctgtaatcccagcgactcgggagcctgaggcaggagaatcacttgaacctaggaggcggagtctacagtgagctgagattgtgtcattacactccagcctgggtgacagagtgagactctatctcaaaaaaatatatatatataaatatataaatatatttatatgtatttatatataatatataaatatatatataactatattaatatataaatatatattatatatataactatattaatatatatatatatcagctgtttttagattatcttaagcttttccttcaagttgaagagaagatcgttcaacaaaggaaaggctttctcttatcaaaatgaaaaataagtacatatgtatgccggtgtgtatattttaaatttttattttatttttttgagatgagtctcactcccgtcgcacaggctggactacagtggcacagtctcggctcactgcaacctccacctcctgggttcaagtgattctccttcctcagcctcccaagtagctgggattacaggcatgtgccaccacacccagctaatttttgtattttttagtggagatggggttttgccatgttcgccaggctggtctcgcactcctaacctcaggtgatccagccacctcggcctcccagcgtgctaggattacaggcgtgagccaccgtgcccagcctaaattaatttttaaagttacagattatactttaaaaatatatcaagtaatgtcatgcagcttggcagtgctgacatatagatatatacatttttaaacttttttctctctctcagtttctgcctgtccttcgttctttctttatgtatgtgtgtgtgtgtgtatgttttcacaaatgtaattatattgtacattctgggttttaaccttattttttaatttagaacatatcttggatatttcccaaatcctttaaatattttctccaatttagtatagtatttaatatctacttaatattctgtttcatagatgatctgtaacttatctaaccagtcagctattgctggactcagaatgctgaattctacctccctgcatgcatcttttttatttttgctttttccagtaagccttttgcacccctaacctgcatgcatctttttttttttttttttttttttttttgagacagagtcttgctctgtcgcccaggttggagtgcagtggcgcgatttcagctcactgcaacctctgcctcccgggttcaagcgattctcctgccttaggctcctaagcagctgggattacaggcatgtgccaccatgcctagctaattttttttgtatttttagtagagatggtttcaccatgttggccaggctggtttcgaactcctgacctcaaatgatctgcccgccttggtctctcaaagtgctaggattacaggtgtgagccaccgcgcccggcctaacctgcatgcatcttaatacacatcatttgctttgggtagagtcccaaaattaggtttggatggtaaaagtctctcacatccttctacatgccatgttttaaggtcctacaaatctgtagcatttacacagtattcatttccctgtgatgttgctcatctggcatattattaatcttttaagtctgccattctaataattgtcaactggtatttccttaattaggatctgcttcattgtattgaaatttaataagttcggtggatgatatgctgctatttttagtgaattgctcatgcttaagtttcatttgaaaacattctgggcttcagaggcaaaagccagagttgagagcaagaccctgtctccaaaaaaaaaaaaaagatagtttgctttataattagagaaatgtggattcagaacacagctctgcctcttactaactgtgaatttgggcaagttacattattttaagccctcattacctcatctgttggatggagataaatgcattgcatggttaaatgttaatatgataaaggacccatcatgcagaagatcctaaaaatagctacttttgttgtcatcacctggcaaccgtgggcatgaatttacaccaccccagccttgatattgagatatcttccccagtttatatgcgcagaatggtggggttggaagtagaaatgatggcataacaggatcttattaacttaagtcattttaggagttttgacacacatctggtctcagagtcacttgttcttccccccagccccggtttctctggattctgtgcttctccatggaggaaactcaaggagaactgacaagttcttgtggttctaaaaccatggccaatgtaagtttgtgtttttcttccttgaaatactgtgtttttaaattcatgtgatcattgaagtctcgttatcttgagacttccttcctaagacaaccctgttgtggaacctgctccctagttactccctagttacagtgaaggatagtgccaaatagcctagtgtcttcctcatttgctcctgttttctcttatctgtgctcaaacattgtcttccatgtcagcctcagaggcagaggtcagatcccatgcattgagaggcttagaggactaggctggagtatgattggggcctgcatatggtagtttcaggcatctagccagggaatttccaagggatgaataagaaaacaaaagtcaattttgtggttgaggaggttgtgctggtctccagtgacatcagtgtcattgtggatacgtcagcatcctctggcttaggaacaaagcaagtattcctgaggtatggcaggggtagcaggtaggaagatcctccaatccctaatgatggctggaaataggctctgatccctaatgatgggtggaaacagaactggggaagaccttaaacattttggccaacctaaatgcctaagaataaaagaagaattagtctgctgtatctttaagatggatgatattattagctagccaataaatatactaactgaagacttttcttatgaggttattttgcatcatgatgaaccagagttttaacgaaatcacgtaatgtcagtcaaatcctgttttctaagagagattttagagtactttttggtgaaaaaattctttttccaaaaattttttgaagggaagagaggatgatggaacttgcatttattcagaactttaactgcaggcacataatgggcaatgtgcttatttatgctatttcacttaatttgcatcaacaatattctttaaaagcgtatgaacactttatttcagaaatattaatttctttattcttttacacacattgcaggcttgagccccagtttatttgcttactatgttgcttctttcctgcaaagcagttttccatcttgaaaatacatttaatttttttttaatacataggcttgtcatttcaggtatctttggcatttagggatgtgtccatagacctctcccaagaggagtgggagtgcctggacgctgtgcagagggacttgtacaaggatgtgatgttggagaactacagcaacctggtctcactgggtaaggtatctttcgaaatcgtttacaatctgttttctggagtatcagctttctccactgtcaaactttagaactctgttttaagaggctgactgacacccctatttctaaagtcatagtttcagcagtgttggggtggaaatgggcacctgtgttaagcaacttcacctttctgaccctcagtgacattcactcctccctctgacttttcctgtcattgcttgcttttctaaataatttccaggtttgagttgtgtgacatcagatttcatataatgcatatactcagaattcctatagctgttctgtgttaatatctgaccttcctacaagacaacagctagtctcagaattctagttttccttgattatcaaaagaacctccatggattatacagtggtggattgagttaacaatagtcatttaaaactcaagccaacacaccccatcctaaaggagacatattctccttaacctgctttgcggttgaaagttaaagtctgtgaattgacattttctgttgaaggaatatctgaggaagaacctggaaatattttaggaaacttagtatatttctcctaggaaaatagtaccaacaacaaaataatactatatactgggcatattatatgcctttgcatatattaattcatttaattctcaccacagccctaagaagtcggtaatatcagccccattttgcatttgataaaagtgaatatgtgcagggtaactttgaaggtcacacagctggtaggtggcagaagatttgaacccaggccatagggctccagagggtgtgctcactggtcccctttctatactgccgttaacagcaaagcagaccttttcgctctctcaccttgtctctttagtcctgtaattgtgagtccatgttaacgtgaatattcttagatggcctttttcttctttactgtcatggcattgtctagtaccattttcacctgcagtttcttacaaatgtaaccaagtctgaattgtcatttcaaggttatggttgtttttgtttttttctataacatgtgtcatttcttttctcatgagcaggatataccattcctaagccagatgtgattactttattggagcaagagaaagagccctggatagtaatgagggaagggacaaggaattggttcacaggtgagtgacagcaaattaggcgggagggtgctatcacaagttatgacccatgatgtcagggaggaggcacagcactgagttgtttggaaagctcccttcaaaggcctgaggcctgtggaaaaaggactgatacctgggaagcattcagattctctctacattagctaccaaaggaactttacccaatttgccatactccttgtttctcttctctcgtatttctctcctctttcaaagtggggctgctttctttcttccccattgatgaccattttacgtgtgtttccaggcctcctttaacattttgatttatattcatttctccattgtccaagttttattcatcaaatatttcccatttacctaacctaagccaggcactgtgctagagtttaggcactactgatagacactcttgtcacagagatgttgatattatagtaagggaaacatgttgtcaatacgtaaacagataataatcaagttttcatatgtgttgtgaagaaagttaagtagagtaaggagctagagtgttggggagttagtagggctaatttagataagatcaggaaaaggccattttgaggtgatgatatttgaaccagagacataaagtaaggtctcaggccatgtgagtattgaggaagaacattacaagcagaaaaagctgcaagtgcaaaggttctgagatgaagaaccatctgtgtttattcccaaagtaaattatgccacctgatgtgaacattcttgtacaattgtttttgtgttcagatgttttcatttctcttgggttttcatttttcttgggaatatatggaagtggaatttctgggtcataggacaagtgtattttcttaatcatatttattgaggtataatttatatagtataaaatgtactcattttaagtgtcaatttttataacattttaaaacagttttattgacatataattagcatacaataaactgcacacatttaaagtataaaatttgctaagttgccctgtatattgtgaaaccatttcaaaatcaaaataataaacatatccatcacctccaaaagaaatccctccctcatgtccctctctacccactgcccaggtaagcactgatcatctctctgtcactataacttagttttcattttctagaattttgtataatggaattatatggtgatttttttcttccttttttaaaaatatggtgatttttaaaatttagcttcattcactcagcaaaattattttgagattcatccatgttgctatatgtatcagtacttcatttcttttcattgttgagtagtattccattgtatggatgtaccacaatttacttatccatttatgtataaggatggacattgagttatttccagtgtttggctattacagataaagctactggaaactttcatgtaaaattcttggtatagacttatgctttcatttatcttgggtaactgtctggggtagaatgggtagatcatatgataaatatatgtctattttttaagaaactgccacactgtgtttgaaagtggttgtatcagccagtagcagtggcttatgcctgtaatcccagcactttgggaggccgagacaggtggatcactggaggtcaggagttcaagaccagcctggccaacaaggtgaaacttcatctttactaaaaatacaaaaattagccaggcatagtgacaggcatctgtaatcccagctacttgggaggctgaggcaggagaatcacttgaaccctggaggcagaggttgcagtgagccgagattgtgccactgcactccagcctgggtgacagaccaagataatgtctgaaaaaaaaaaaaaaagaagaagaaagtggttgtatctttttactttcccagcagaagtttatgaaaattccagttcttcgacattcttgttagcactttggtatggtcagtcttttaaattttagctttgctaataggtgagtaatggtatctcactgtggttttaattttcattttcctaatgcctaataatcctgagcaactttttattcttaatttatcatccatatatcttctttggtgaagcatctattacagtcttctgctcattctctttgcttctttctttcttttttttgaaacagagtcttgctctgttgcccaggctggaatgcagtggtgcgacctcggctcactgcaacctccgcctcctgggtacaagcaattctcctgccttagcctcctgagtagctgggaccacaggcatgtgccaccatgcccagctaatttttgtatttttagtagagatggggtttcaccacattggccaggctggtctcgaactcctgacctcagatccacctgcctcagcctcccaaagtgctgggcttacaggcgtgagccactatacctggccttctgcccattttctaattgcattggttgtttgctaattattgggttttgagagtcccttatatattctggatgtaagtcctttatcaaatgtatgatctgtaaactcttaacagtgtcttctgaatagcataagctcttaatttgattaagttaatttatcacatttttctcttatggattgtcctttcagtcatatttaagaaatctttgcccaatataaaaagtacaaaaattttctgttttcttctaattttttttttttttgacagagtctcgctctgtcacccaggctggagtgcagtggcacaatctcggctcactgcaacctccacctcccgggttcaagcaattcttctgcctcagcctcccgagtagctaggactacaggtacacgccaccacacccagctaatttttgtatttttagtagagacagggtttcaccatattggccaggctggtctcaaactcctgacctcatgatctgcccaccttagcttttcaaagtgctgggattacaggcgtgagccactgcccccagcttttctagaaattttatggttttagatttttacatttgtatacctattgtacacaaactcttccagaaactttaagataagggaatacttccaaactcactcttcaagtccagcattaccctgataccaaaaccagacaaaggcattataagaaaagaaatctataagtcagtatctttcatgtacacaaatgcaaaaattctagactaagttttagccatttgaatccaacaatttatgaaaagaatagtagttactggccattcttggcattccttggcttgcagacgcatcactgcagtctctgcctccatcttcatggcaccctctcttgatctccctatgcctcgctcttataagtacacctgttattggatttagggcccaccctttttccatattaggtcacattcacaggcactgggagttaggaacatgtcttttctgggggccacaattcaacctactacatctgagaataaaggcgtttatttttctcctttctaaagcctgtgttcttcaccttgccttactctactagccaggacctgcagtgtaattcttgactagcaatgagtttgaggatctgtgaatgagtaatgataaaacaactgatgctcaccaaataaaatatctcagtacttgagttgggacagagacaaagagaaggaacagtagccacacacacagggcaaatgtaaacagttttggagatgcctaatgttcaaggtaacaataggtaattggaaaatgatgaaatacaaaaatgacttttccatttatacttttgattgagcaattttggatgtatctttgttccctttcagaagggaagtgatccaggaaagagcatatttaattgctgtactaggatgagattggaatcagggagatatattcataactatgttgtaatttggggaaattaagttattatacttagctgccctctcagtgacttgtttgtaatatttacagaggtggtttgcagaggtcttccaaataagaaaggggtttttatcaatggtaatatgtttgggttttattctagggggaacgagaaactctattctaaagggaaaagaattaggtacagattttcaaaatgatctccatcaaagccatttgatgaaaaagattttaaatgcacatatccaggacttgctcctatagattttgattttgtctggtttggtgcctgaagaacagtatatgtaagaaatttccctaaatccatcctaaataagcggatcactgatttaccctattatcctattcacctattttaccattctttttttttttttttgagacagagtctcgctttgtcacccagcctggagtgcagtggcacaatcttggctcactgcaagctccacctcctgggttcacgccattctcctgcctcagcctcccgagtagctgggactacaggcacccgccaccacgcctggctaattttttgtatttttagtagagacggggtttcaccatgttagccgggatggtctcgatctcctgacttcatgatccacctgcctcagcctcccaaagtgctgggattacaggcacgagccaccgcacccggcctattttacaattcttaaaagtcacatcattttctgaggtattttgccttcttttaaattgcactacaataatttagagttctctaagccaggaaccagcaaactatagcccatgagccaaatagctcactgcctgtttttgcatggctcttaagttacaactgttttttccatttttttaatggttgaaaaaatcaagattttgtttcatgtaaacactttttgaaatttaaatttcagtgtccataagtcaagtgttattataacacagccacacttattatcatctgtggctacttttgtgctgtaataacagagctaagtaattgtgacagagaccatatgcctcccaaggcctaacaccttcactatctggtcttttaaagaagaagtttgttgaatcctgctctaaaccatttatttctaatgtatgttatttctgtttatcttttatttctactatgaggtacaacccccatccctgccccaacacagaaaaatagcattatagcatttgtttactctttgcttttttttttttttttttttgcagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatgatatatataaataatataattctcataattccacctctgcctatgtggtgtttggcaaaacatgcccctgtgccttggtttttaaaatggtaataacagtaccacctaatagtatttttgtgaggatgaaatgctaataaaagataaaacctttaaaagagtatttggcacacagcattttatcaataaatattgctttatttttttcattggggatacatttagtacattcatgtgagaggaaggccctgtgggtgtaagaaatttgtaaaaactgtccattacctttcactccttatttagattggaataattaactggagataatatccagtaaaatagattaaacttccatttataaagtcagaacctatctctgaaaattaatgtgagaaagaaatctctagatttgatgggtgtgaagattatgagagtaaagttttgaagactcagggatagctgtaatgcttttttctttttataacccaaaaagcaggtatgtcagtcgctttttctgcccacaatgataaattaaaaacagccactatccatttggaaaacttaaaagaataatgaacagttatgttctatctagattcagcaattgttaatatgttgtcacatttggtttgcttatacataatatttacatattttgctgtagtatttgagtataaattgcagatactataacacatcacatctaagaataaaggctgcctcctacttaattgctatataacaattgtccaacctgtctgtgccccagggcagctttgaatgcagtccaacagaaatttgtaagctgtcttaaaacatgagattttttttgtgattttttttaagctcatccgccattgttagcacattttatgtgtagcccaagataattcttcttccagtgtaacccagggaagccaaaagatttgacccccagtaacttcacacctaaggagattagcaataattccataatctgtaatattcagtctgtgttcatattctcagttgtgttcattcttttcatttgtgtaaacaatgcttttcataggttatttttaaattcaggaaccaaattcatgaattacatttgtgcattgttcgtctcttttaaagtaagaatggcccttccccccacaactttattgcaacattgactttttttttttttttttttttttttttttgagatggagtctctgtcgcccaggctggagtgcagtggtgcgatcttggctcactgcaagctccgcctcccgggttcaggcaattctgcctcagcctccccagtagctgggactacaggcgccttcaaccatgcccggctaattttttgtatttttagtagagacggggtttcaccatgttagccaggacggtctcgatctcctgacctggtgatctgcccgcctcagcctcccaaagtgctgggattacaggcatgagccaccgcacccggccttcccaaagtatttttaaatgtgcttttttatccccagtatttcccattaactggaatttgggattagagacccaattagggacagattaaatattttggcaagaatacttaatgggagaaattttgtatttcaatttgtaacccattaggtggcatacaatgtcattataccactatggtatccttagttcattcacttggtgtagcagaacatacattccaaagatggccacaccaatatatcccattctgcatgttcatcttacaatgtgataccaacactccccaagaggtagagctcatggtccttccttttgaatctggccaggtgggcctgtgtttatggcaggaataacactgtgatttccacgactaagtcataaaaggcaatacagcttctgcctgacccacttgggatgaagcccagccaccatgctatgaagatgccaagtaatcacatagaaaagctaagtaaagctgtcctgattacagctgtaattgaggtaacagccgggatccagcaccaagtgtatgagggtatgagccttcagatgattctaacccttagccttcaggctatcctagctggtgctaagtggagcagagaaaagctttcccccatgagcctgcccaaattgcagatttacgtttaaaatatggcctgttttaagccactaagttttggagtagtttgccacacagcgataggtaactgaaatacttgcttcatatggtaatcaccaggtttctctgttgtagagctaaatatttcttttaatttagtaaacgatctgtagagtagtactttggcatttcggaaatttaaaatctccaataatataatgacactagatcaaaaagaaaatgaaaccataaaggacaatttagaaatgaatggtaagatcagaatttgtgaatgtggccaaacctgtgctcagtgaaaaatcagtaacctgttaatatattcaggaaacaaatattgagggccagcactttgtttctcctgctcaccactctactcccagtgacttaatactgtctctttaacatagtaatcacttataaaactgttaaaagaatgaagaagcattaaactcaagaaactaagggaaaaataagtcaatataagaaagaagggaggatcattaaaaggagttaatgaatttgaaaataaaatagacttattaaggctttgtgaaaaaatattaatacttgattttagtatagctaatcaaaggaaaaagataattacagcattgtgaatgagaattggatgtaagtacagatggaggagatattttttgttttattgaaaatttcaaggaggaagtaatatcaaaatttcactagctctttctacactgatattataatcctgataatacaacagatgaggatagttcttaaaaggcaaaaatgtaggtgagtcattacgaagaaagcagaaattctaaaccatcagcacattcattcaaaaacctagtaaagcaattaagcaaaataatttgtttacttggactgtccagggatagatctgttctagttttccaaattaatgatgggaaaggaagagctgatccagtccaagtatcttcaagatccatgttctcagtttttcttagctttaaatggccaaattgtggcttagattggatatgataatttcctcaatgcttaacactgagcacaatttttcacatatttgaaatcaaggtgtatcttacaatttatggcatctgacaatacttccaaccaggtggcagtcatcaagcagttttgtgaaaagccttcccggtaagaatacaaaagcatctgcaccaaaatatatagatttaatggcatgtaggggtttgcgtgaatatatacagttgaaattcaattcttccttaaaaataattgtaactcatttctttaagactaccatactaccactttcctcaacttggactaatgtccattgtcaaccaaaatgtctgtgatctcatggatccattatgatttgcaactccaggtccattttatgcaaataagacagccataatatatcattgtacaagtcatttactatctaattatatcattgctcaacatttgcaaattatttttacaaataacaataattggatgtaacaaaaagcagagtattttgagacgtatattaatgcaaaatattgttaatgtatcagtggattgttcctccaaagtaccagtgccttaacacaacatatctaaaagaacatctctgggaacagtagtacttaatggcaacttgagaattggtttgtgggcacacagccttgtgaagttttgaatactaaatcccttttttaaaaaagtgcttattatcaggctatcaatcaaaagatttgagtctttcagtaaagaaaatttgcttaattttatctagtgcatgataaactttactaaggaagtctcattcagaatatctaatattttggatgtgagcccacactggaaatgccataaccaaaaaagagtgaccctaaagatagaatattcagatctaatggcagatgcttagctatgctgggaaaggaagtgaattgtatattgctctgctgctcacatattcctctgcaataaattgctggcccagtttagtttttatatactcactactatactaatgaggatggctcaattttttatttgaacgtactataatgaatttaaactttcattggtatttatgttttaacaggttttcactatttcaaatatacttcaataaatatccttgtctgtgatcattggtttatgtgaattggaatttcagtagctgtatatacatggaagtacaattgctcatacatcatacactctttcagttatgttagataatactaaatcaaccatgggttctgtataccctactagatatttccaaattgttctcttagactcctgagaactggtaaattgagtgctatagcttcagtttaggtatgtttttgtatgtattcctaaattttgacttaagccatttttcaaatgtatttcttggcctatcatcattcctttactttgactttcatattcttggctttctccattatttttgtcttgtttttttcttccctctaattgacttgaatgtcattctggatactttgctatgttgatgcagtattttccaccacatgcatatagtctgaccatgcattctatctttatgagacattttaagatttataggttatcagttatgtaatctttgcagattacacaaataaaattttattttccagtatttatatttatttttcttattgcaatagctagaatcttcagaacacagttgaatattatggtagtaggtatcttttgtttccaaatttaatggaatatttcccaacatttttttctttggtcctatgtttcctcaagaacctacatttaatcatttactataatattcactcttcatttggggataaattctctgctgactttaaatttccttcaatatatgtaggggtagagggaggatgcctacttttgtagtgattgttaatttaaaaactgctgaattttttccaaggccattttgttatctattttaattttatgtttttctccttaaatttattgatgtattgatttgtacttatgactttattaaattttaaacatttcttgtaatatgctacaatttttgtcatactgctagagtccatttggtgatattttaattagaactttttcatctatagtcaaggcagtattatagtttctttttattttattgataagattttagagttgtaatgatctgttctttaacacctagaaacaatttgtccttaaagtatttacatttttgtatcttgatattacattttatgatttgctaaattcacttagctttagcagggttttttgttttttttttttgagacggagtcttggtctgtcgcccaggctggagtgcagtggcgcaatctcggctcactgcaagctccgcctcccgggttcacgccattctcctgcctcagcctcccgagtagctgggactacaggcacgtgccaccacgcctggctaattttttgtatttttagtggagacggggtttcactgtgttagccaggatgatctcgatctcctgacctcgtgacccacccgcctcagcctcccaaagtgctgagattacaggcgtgagccaccgcgcctggcctagcagggtttattttttataaattacttagaattttctataaacgcaatcaggacatctgtcaagacagttccttttaatttatatttcctttatttgccatactgcacaggctagggcattctgtagagtgttgaatggaaatgttcaaagcaaggctgggcgcagtggctcacgcctgttatcccaacactttgggagtctgaggcagttggatcacctgaggtcaggagttcgagacaaacctggccaacatggcgaaaccccatctctactaaaaatacaaaaattagctgggtgtggtggtgcacctgtgatcccagctactcgggaggctgaggcaggagaatcacttgaaccctggaggtggaggttacagtgagccaagatcgtgccactgcactccagcctgggcaacagagcaagacgctgtcttaaaaaaaaaaattatcagagcagacatccttaccttgagtctgactttagtgaaaaagcagtcaataatttatcataaagttctatgttagctgtttattttccctagatattctttttggttttttgacaaatcttggggcaatttgccattgaagtcatctgagtcaacctttctttgcggaaaggatttttagtggtagtttcaaggacaatataccaaaaatattgaatttttctatcatagcaaacaattgaaaatgaaatcaaaaaaattttcattgataaagaacataaaatacttaggaatatatttaacaaaacacatgcaagactactacctaaaaattacacaattttgttgagagaagctagggaaggccttaataaattgaaacatcttccataattacagatgagaagacccaatgtttagaagtcatttctcaaattgatctagggattcagtggaatccagtcagaatttgttctggagcacagcagtgaagtgaggattggagggagctggtgtagctgcactttgaggtaggttcattagctgttgcaaaaggctggtgatagtcactgttggaagatgatagaggaggagagagaagggactcagtaagcatggcagcacctcatcttgtgcatctttcttgataaggaaagggaggtccctggctgttgtcatgaaaatgtcagctgcttgctctgtggagaggaaaggaagaatacgggcaaccactgtcttccctttttggatacacatgatctgtacaaagcggtcatcactaggcctctcttgtccaggctgtttccctcttaagttgtcatacatgctacaaattccgtactttcgctcatccattagagcaggtcgctgtcttagacttaggagataatgtctttcatagtcctccacatcaaggagtaaactgtaggttttcttaattatgacgggtttttctcctcttgtctcgaatttgtttttcttttatctcatcatcctcactccaagatgtcacaacagcatcaatcatttttcagggattattcacactagaaacagtaagctttcccaaagagcccacaaattgtactggcttataggtgcgctccagtttggccacttgaggggtaataagcttgttatgctcctttttagggccatcacctcgtatttcttcagcagctgatggtttctccagtttttcaaagtaattctggtaataaaaatcatccaggtggggaccattgctttgcagttgcatcatctgaattttagaggcccaatccttttcccacagcaacatgagattggcatatggatcctttcggagatgatcttgatgactgctccagtgacttcctctatctcctgcaccactgagattctgatgctgatttctattctgttgctgtctctgatgcaagagtcaatggtgctgtggatggaggggagttgcgtccagtctaaacactgggacttgagatcttaagttttgcaagtgaggtcctgggccaggagggcgctgctgtggaggtggtgtagcggagggtggagcactaaagaaggcatggaagcctggtgctgggggaagcatctgcccaacttgcccttgtagcaacttgggattcatagcagcatgcagactaccaacaaatccagggacccatgcaaactggctgggagacatctgtccaggctgtagctgtgctcctccaagaagctgtgctctctgaaaggggctgagaacaggaggaacactaggaggaaaagggtgacccaggagggaagagttcaggacactgtagagctgatttggaggcatcctctcatcatagggaccaggataacacggtggcattgggggccgaacatggacaggctttgaacgcagaatcttccaaattggctttcgttttcagttgctggtttcaggcggaggaaagtctatggaataggactgcacaggctctgttgggtaaagctgggtacggccatctgcttaggtggggtgcctatggggacagctctaacaggaggactgccaatgacaggtgaagttgaccaccttggtaatgcatgttcagaaaggtcccaatcattttctggaccctggggggcctctgaggcaaggcatattctaatacagacactgtagacatttcctaagtgagcagtggtcctcagatttgcctcataactttggatccatcccagatactggaattcagatttcctggttggggttataaaactggcctggtctgcactgccctcatgatagctggatcttctagttcattttcaatcaccatcttactgagcctttctgccagattttcctcatggtcacccaacaagtccatttcttccctttctccattgcctgtttgttcattaactgccactggtagcttttcttccaattcagccaggcactcatgtgcttcctgccaatcatcatcaactgcacctgacccaaaaatatcatcattgaattgatcaatctcttcatcttcttctctcagtccctgaaattcatcttcatcttcatccagaagacaatcctcccaagactcatagtggaacattcttggggaggtgggggggagtggggaggggagtgggggagggagggaagaagcactgactccctgggctcctccatgggcaggtcctccaccagcttgcgacccctggccacctatttctgtttctttttttgttcctatgaattctagttactatcatgtatcatttccttactccaatacaactctgctgtcatttacttcctttatgctgttattgtcaaatatattacatttccatgttataggcccaacaatataattatgtacatactgtattatacaactgccttttaaatttattaagagaagtaaaaagaaatgtgcatttgtgctgctttttgtaattttaattatattaattttgttctttttaaaaatgtggttttgaatttccatgtagatttacttgctttgtttgaataacctttacaatttcttatgtggtaggtctgggaagggctttatttcaccttcatttttgaaagacagtgtgttactgcttgacagagcttttgtcgtttgagtactttgaatatatcatcccactaccttcatcccctccattgctttggataagaagtcagctgtcaatcgattggtgttccattgtaagcgacacatcatttttctcttatatttttcaacattttctttcacttttagcatttctactatgataggtctgttcatggatatcttcgcattcattctgattacagtttgttgagatgcttgtgggtattgattaatgtttattcaacaaattgtggatgtattttgccattatttctttgaatatttttgtgctcatttctctttctcctttccttctggtattctcattacatgtatgttcatgcacttaaaagtgctctgttcatattttcttgttcttcaaggctctgttcatattttctttgttctattttctcattctatttcattttattttcttattcttttttctagtgggaagatggaattgaggttgcataatttccattgatctgtttgaaagttttctatttacttgctgatcaaatttgtttagcccttctaatgaattttttattttggttactgtagtcttcaactccagaacttacatttggttcattttgtcatttctccttattgattttctttatttgatgagacgttatctttatattttcctttactgctgtgaatatataatggctacatcgaagtttttgtctattaaatatgacatctgttccctgtcataggccaacctgttgccgtttttttttgttgttgttgttgttttgttttgtttttttttaagagtcttgctctgttgcccaggctggagtgtagtggtgtgatcttggctcactgcaacctctccctcctgaattcaagcgattctcgtgtcttagcctagttataggcatgtgctaccatgcctgcctaatttttgtatttttagtagagatgggatttcatcatgtagtccaggctggtctcaaaactcctgagctcaagtgatctgccaaccttggtctccaaaagtgctgggattacaggtgtgacccactgcacctggcctgcttgctgttctcctgtgtataggtccaactttcccatttgtttgcatgtcttaatttactttttattattttcctaataagtagacatattaggaaacatactgtagtgatttgcctgtcccctctccagagcttgttcttgttgttgtttgcttggctatgtattttgtgttttggctaagctattttagtaaaatcgatttccctttccccttgcagtgtgaagtattttgtgttgttcctcagccttaaacatatgcagttaccctgctgtgacaatggttttaaacaggagtctttttgactatctttccctatctctctgttaagataactgcccccttggtattatttccagcccactaagctccgctgccgtctatctggtcactccattgttttcaacatttccttggagcctaaattattaagcagtttaatataatttaagtcaggcagggctaatttttgaggccagtttttaaggtttcttttgacctttggagggctccttagctgtctcttcccatggaattatctgattaactacctggcctatggtttatgttgttgtgtttactttaggggagctatttgtttgacactgtttcagataaagtccattcctttggagagagcttcagagctctattcttatggactgccactccctctggacaaaatctctgaaccaccattctgggtaatgggctgggttgtagccatcttgttttttatgttatgaaacctctgccttagaagcaagtggaggcaagggcaatctgggtgcaaatgagttcactctgcctgggtagagtttccaaactctgggtggggctgggggaagcaaaggagccccaaacctcctagttgcgttcaccaggaatttagccactttaaccaagagctggtggggataagaaaccctggaggcatgcccctcctgttgatatatgacaaaccttgattgacagctgcagccccatcatcttggcagcatccacccacagagaagcttctatcaaattgagctgtgaagagtaaaagggagttgtgtcttaaatgccacaaattctcttaccaagttcttggttcttaccaagttttagtagaatttcttgatatttcacttcctatatactgtttggacactttcagacctcaaatggcaaggtttttatacatttttttttgccagttttattagaaaatgagtttgcagagcccccccatctaccatccagaagtggaactacatatagtcatttaacaatagtttagcattttctgtcatctcattctggagaatcatagatgtggcagaaatacatattcttgaagaaaaaaaatgtctcccttatgggtactgtgatttcaatagggtgtgggataagtacatgacaacatgcatgggatagacactctgttctctacagatccgtgctttggaattacagaacataaaagatataatgatggttattactttttacatgtgacaatctagttgtagcgtttaagattaaatttggttgtgagtaaaatagtaaaactgccccaaattaaagtggataaaatataataaaagttaatttctctgtcatataatatggatgtaagcctgatactgtggccttgctctaaaccaatcatgaattttaccattctggcatcagaatggaatgagcactcagacttatacagaacttggaagaatagtaaataattctggttacccttcacccagatttctcaaatattaatatattaagctagtttgttttaagaggtttccagaattgccaaaatattcacttacatcctacttgccataagttatgtcacatgacaacaccttggagaaataactgcagtccttattctagatagtcacagccaactatcaataaaaattactggttctataatcatgaaagcagggtagaatggatatgcgggcctaataaataacagatcctgacccactgaggaatcctggagatggtttcattttgatcaattacaaatgaagacagtgaatccctgagaccacaacttgtgcagaagactcattgaaatggaatggtattctggaaattaagacacacaggtccgttatccctcataccccaagctggatgatcacaataccctgtaaaaggatgacagaaatcttgtgtctactttttcttcttttctggggagtctatgaacattcaagataacatccatgactgaatattctaaaacaagtttctttacaacgctgctcagaaacaccatgacaaatttaaatcagagcaatatctccaaaaatgggaggcagattaatgtatcatttcagccaggccttaaaaggagataaacttctcagctatcaccatacataaaacataattcaataaaataccaaatgcaaacaagagcagatcatagaaatgtaagttgagaaaattcagagggaacttctgaccttaggatgacattttcaactctgaaactattaaaagaattctaacaaaagcagcatctttttttccatacctgtaactgccatgtgcactcacagcagccagattttttggtctctaattcttttttcctctaaaaggaaccaggactccctaagataagagggtattaaatcatgagttgattccatgactcaggacaagaggcatgggggacatgaaccaacaaacagggtcagtcttaaacatcctcttacggcctgaaaacaatattcctttaaaacatcaaaagaaaaaaataagtagtaaaaaaaaaatgtaaatggattcctactggccacattatgtcaatttgagcataaataataataattactacaggtgcttctcaacttacggggagttatgtccaaataaacccatcataaattgaaaacatcatacaccatatgtgcatttatggtctacaatattttcaatttaacaatgggtttatctagatatagccccattttaagtcaaggagcatactctgactgagtatgtcttagttttgtgttgctataaaggaatgtctgaggttgggttattaataaagaaagaggtttatttggctcagtgttctgtaggatttacaagaatcatggtgcaacatctgcttctggtaagggcctcaggctgcttccactcatggcagatgaaagggggcagtgtatgcagacatcacatggcaagagaggaagcaagagggtgaggaaggaggtgccaggctcttttgtacaaccagctctcataggaactaacagagtgataattcaccccccaatccagagaggacattaatttattcatgagggatcttctcccatgacccacacacctcccattaggccccacctccaacattgggatcaaacttcaatatgagatttggaggggataaatatccaaactatagcagcatatcacttttgtactattataaagctgaaaattataagtcaaaccattttaagttggggattacaggcgtgagccaccgtgcctggccgtgatttttaaatttgtacatacttggtttgtaactttaacaaatatattaaagtgttttattatgtttgcaaagggactctgacttccaacatagtactgccatgattgcatgatgatagagtttcaccgaaaggctgccagggatctttctgacaactcttaatgatactaccgggatgtgcaatgacccagaaaggagttgtgctaggttaatacccagggactctgctgatttcaaagaagaaagttcaagagaatggatagaaaaaagatgaaactggaaataaaaaataggaacataagatttgaaagccaagttttatataatcttgttttataagttgtataacatcattgcaatatcaatacctgaaaaatacttggaaaattataactttacttatgattatagatgcaattaaatggtaaaagatagaattaagtagtctattgaaagaataatcatctgaccagggtatattcataaaaagaagaaagctatcaatataaattatcactttatagatttttcaacacaatggaataaaatcacaaaggattattcttaatcttaaaaaaaatttaatctaattcatgatgccacatcggtatcatgttttgttttggggtttttttgagatgaagtctcactttgtcgcccaggctggagtgcagtggcacgatcttggctcactgccacctccaccttccaatttcgagtgattctcctgcctcagcctcccaagtagctgggattacaggaatgcaccaccatgtccagctaatttttttatttttaggagagatggagttttgccatgttggccaagttggtctcaaactcctgacctcaggtgatctgcccaccttggcctcccaaagtgctgggattacaggcatgaggccactgctcccggcttaatggtatcatgttttacagcttgatttaaagggttaatattttttcaaatttttatcaacagctcatgtaccagccatggtataggtgctggtgataaatgctgaacaaaaaagaggttccggacaatcttggctccctatacaatccaaagggtgccagttttgtactgagtacagtgtcagccatatcacacaagttgaattatgttgacgctttaatggcattcatttctcaatagtctatttcaattttcattttgtattcaatccagggcttaagtacacgtgactataacttttcagagatgacaacgtctctccatagattacttacccactacaaactaaatctttacaatggacttacggcggttaccagcttacccaaatgatcatccttagtttcactaatgcaaggacctgtacttaaatgttttctgacagtacaatatgacatagaaataacctacaaagtattcttccccaaaacgtttaatctagacctaagaaagcctctggacttactttcccttgtaaagaaaatacaaccaagaacaaggctaaatgacactataaagaaagaaatctaaacacatagccaacaacatttctgggctactcaaaattcaatgtcatttttttaaaatgagaaatgttctagaccagtggctctctaactctggttggtatcacagacacaaaacctggagaaataataaaaaacagaggcccaggcttataaactagggctacacttctgtaggtttactaagttccacaggggattctgatacccaccataatttgagagcatactttcatggggtttccatgctacaatacactaaagagagataaccaaatgcaatgcagaatctgcaatggactctccttagaaaatgaatagctgtaggccaggcatgctggctcatgcctgtaatcccagcactttgggaggccaaggcgggtggatcacgaggtcaggagatcgagaccatcctggctaacagagtgaaaccctgtctctactaaaaatacaaaaaattagctgggcatggtggcgggtgcctctagtcccagctactcaggaggctgaggcgggagaatggcgtgaacccaggaggcagagcttgcagtgagcccagatcgcaccactgcactccagtctgggcgacagagcgagactccatctcaaaaaaaaaaaaaaaaaaagagaaaatgaatagctgtaaaagatggtttgcaggccaaggaagaaatctgaagatggaatgatattacagaattatgaatattttccttaagggtaattatggtactatggttatatgatattgtctttatgtttgggtaacacacatgctgatgtaacaaggagtaaagtgtcatgatatctaaaacttattctcaatggtctaaaacttattctcaatggtacaacaaatatacaaaaaataaatgtggcaaattgttaacaattttgaatctaggtgggggggatatgtgtatatattttactattctttcaaaacccacaacaattatcaactaggttcaccatcttttatgggcaggatttgtggtatccccaaacaattacactagtaacaattacactagtaatcaaaaaacactggtcacagatcaccataacagatttaacaatgaaaaagtttgaaatattatgaaaactagcaaagtgtgacacaaagacatgaaatgtgcatatgctgtttggaaaatggtgctgatagacttattcactgcaaggttgctgcaaaccttcagtgtgtataaaatgcagtaactgcaatgcacaattaagcaaggtacgcctgtatccagtaaaatatttcacgggcagtaaactgtgaacatggcagctactctacattcctcacatcagtaactttctcaccaaaattatcttctctgaactctaaggcatttagtgtggctataaaatatcccacattctttacactcaaaggagttctcagcagtatgaatactctgatgttgagcaaatcccaggccacgatgaaagttcttcacacattcttttatgttcacaggatttctcatcaatatgaattctctggtgttgagtaaatttttcatacacagtgaaggcttgtctacactccttatattcataaaacttctaactataatgaattttctgatgttgcgtaagcagatcattcacagtaagggtttgctcacattctttacattcatagggtttcatgccagtatgaattctgtgatgtgcagaaaggactgaactaagtctaaaggtcttcccacatcctttacattcacagggttgctcaccagtatgaattttaacatgttgaacaaggctcgagctacaagtaaaggtctttccacattctttacattcatacggttcataccagtatgaattctttgatgtgcagtaaagactaagctaaatccaaaagttttccacattctttacactcacagggtttctcagcagtacggattctcagatgtacagtaagatcataattactgctaaaggccttttcacattccttacattcatagggtttctcatcagtatgaattttaacatgtttaacaggtttgaactatgactaaaggctttcccacattcttcacattgatatggtttctcaccagtatgaattctctgatgtactctaaggtttctaccactggtaaagcatttcccacatccttgacattcataagggttctcacgaatatgaaatctataatgtccatgaaattggtaatgatattgaaaggccttcccacattccttacattcaaaggttttcacccaagtatgaattttctgatgttcagtaagttgctactgatgtctgaaggctgtcccacatttcttacattcaaagggtttctcacctgtacaagtttttgatgcagagaaagttgtaggtgaagtctaaaagccttcccacactccttacattcatagggtttctcaccagtatgaatactctgaggttgaacaaggtttgagccacgattaaaggccttcccacactccttacatttaaatggcttctcaccagtatgaatgatctgatgttgagcaagctgtgtcagaagaccaaaggcctttccgcattctttacattcaaagggtttctcaccagtatgaattcggtaatgttcagtaagctggtaatgatatctaaaggtcttcctacactccttacatacaaagggtttcgcactggaatgagttttctgatgctgaataaggtttgaaacacgactaaagcctttcccacactccttacattcatatggttttacaccagcatgaatactctgatgttgaacaaggtttgagacacgattaaaggacttcccacattctttacatttaaatggcttctcacctgtgtgaatgttcttatggtgattaagctgggtgtgaagactgaaggccttgccacattccttacattcaaagggcttctcaccagtatgaaatttctgatgtcgaataaggtgcatatgaagtcgaaaggctttcccacattccttacattcaaagggtttctttccggtatgaatacttcgatgttgattaagatttgaaccacgacgaaagaatttcccacattccttacattcaaagggtttctcacctgtatgagttttctcatgttgagaaagttgtaggtgaagtctaaaagccttcccacactccttacattcatagggcttctcaccagtgtgaatactctgatgttgaacaaggttcgagccacgattgaaggccttcccacagtctttacattcaaatggtttctcaccagtatgaatgttcttatgtcgagcaagctgtgtcagaagactaaaggcctttccacattctttacattcaaagggtttcccaccagtatgaatttggcaatgttgaataagttggtaatgatatcgaaaggccatctcacattccctacatacaaagggtttctcattggaatgaattttttgatgctgaataagatttgcaccacgattaaagcctttcccacactccttacattcatatggttttacatcagcatgaatactctggtgttgaataaggtttgaactacgattaaaggacttcccacattctttacattcaaatggtttttcacctgtgtgaatattcttatggcgattaagctgattgaggagactaaaggccttcccgcattccctgcattcaaagggcttctcacccatatgaatcttctgatgtcgaacaagctttgtcagaagagtaaaggcctttctgcattctttacattcaaagggtttctcgccagtatgaattcggcaatgttcaatgagttggtaatgatatcgaaaggccatctcacattccctacatacaaagggtttctcattggaatgaattttttgatgctgaataagatttgaaccacgattaaaggctttcccacactccttacattgatatggttttacaccagcatgaatactttgatgctgagtaaggtttgagctacgattaaaagacttcccacattccttacattcaaacagtttcttaactgtgtgaatgttcttatggcgattaagctgggtgggaagattaaaggcttttccacattccttacattcaaaagttttctcaccagtatgaaatttctgatgtcgagtaagttgtatgtgaagttgaaaggctttcccacattctttgcatttatagggtttctctccagtatgaatactctgatgctgaataagatttgaaccacaactaaagtatttcccacattccttacattcatatggtttatgtgtattatgaataggagaagcatgagtataagcaggcatttcttcatagctgatgatcttctggttgatatatccttcttgatgtccctgtcgtccctcaaatctacttctatattctgagtcatttctaaaataaaaggcctcgaggccaagtgttttacttatttgctttataacatgtttgggtaaatttatttcaaaaatatcattttctggagatattttctcaggtccatattttgactccaaatctgaaagaaatgaagaaggcaaacctattttattttcctataacatacatgcatacaaaatccattaaacaaatggcctaagtataaaatataatactttcagggaagggatctgaaaaaggaaaagggtgccaataatgaatttatgtaagatggtggtgtgcataagggaacaggttaactttgtcaaatttaggtgtgaatcaaaaccatttggtaagattaaatatattgatattcaagcaactcagatgtacagaatcagaatttttagtgaagaaagctttttttttttttttaagacgaagtttcactcttgtcgcccaggctgcagtgcaatggcacaatctcagctcactgcaccctctacctcctgggttcaagtgattctctggcctcagcctcagcctccagagtagctgggattacaaacatctgccaccgtgcctggctaattttggtatttttagtagagacgaggtttcacaatgttggccaggctggtctggaatgcctaacatcaggtgatccacccaccctggcctcccaaagtgctgggattacaggtgtgagccattgtgcctggcctctattttttttttttttttttaagagacagggtctctctctgttgcataggctatagtgcaatggcatgatcacagctcactgcagcctcaaactcccaggctcaagcaatcctcctgcctaagcctcccaagtggctacagctacaggcacatgccactaagtctggacaatttctttttctttagtcttcctgcagtccaaagtctggctaatttttactttatttttatttttactttgtagagatggtgtcccaccatgttacccaagctggtcttgaactcctggcatcaagcaatcctcctgccttgatctcccaacatgctgtgatcaccagtgggagccatcacacccagccaaagctgtatttttaatatctctaccagatgattctgattcagatcaaagtttacagatcatacttaaaactggttttgaatggtttatctttagtcttagcacaaaatccaaaaaccttaacacagagaacaaaacttcctatcagggcactgtcctcctttgtggctgatctctaaccactccctccttttagcaaccagaacatgatataacctttctcttatcttcttgcttgcttagactgcttcatcttccaagaatcgtctggctttgctctttgtaacaaacatccaactcctcttttttttttttctgtttatatatatatatttttttaattttattattattatactttaaattttagggtacatgtgcacaatgtgcaggtttgttacatatgtatacatgtgccatgttggtgtgctgcacccattaactcgtcatttagcattaggtatatctcctaatgctatccctccccacctcctcccaccccacaacattccccggagtgtgatgttccccttcctgtgtccatatgttctcattgttcaattcccacctatgagtcagaacatgtggtgtttggttttttgtccttgtgatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagactttgctattgtgaatagtgccgcaataaacatacgtgtgcatgtgtctttatagcagcatgatttataatcctttaggtatatacacagtaatgggatggctgggtcaaatggtatttctagttctagatccctgaggaatcgccacactgccttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagcgtctgttcacatccttcgcccactttttgatggggttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacataaagtccttgcccatgcctatgtcctgaatggtattgcccaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagataggcagcattatttctgagggctctgctctgttccattgatctatatctctgttttggtaacagtaccatgctgttttggttactgtagccttgtagtatagtttgaagtcaggtagtgtgatgcctccggctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcccaggtattttattctctgaagcaattgtgaatgggagttcactcataatttggctctctgttggtctgttattggtgtataagaatgcttgtgatttttgtacattgattttgtatcctgaaactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaacaggagtggtgagagagggcatccctgtcttgtgccagttttcaaagggaatgcttccagtttttgcccattcagtatgatattggctgtgggtttgtcatagatagctcttattattttgagatacatcccatcaatacctcatttattgagagtttttagcatgaattttgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggaaaagctttttgatgtgctgctggattcggtttgccagtattttattgaggatttttgcatcaatgttcatgaaggatattcgtctaaaattctcttttttcgttgtgtctctgcccagctttggtatcaggatgatgctggcctcaaaaaatgagttagggaggattccctctttttctattgattggaatagtttcagaaggaatggtaccagctcctccttttacctctggtagaattcggctgtgaatccatctggtcctggatcttttttggttggtaagctattgattattgccacaatttcagagcctgttattggtctattcagagattcaacttcttcctggtttagtcttgggagggtgtatgtgtcgaggaatttatccatttcttctagattttctagtttatttgtgtagaggtgtttgtagtattctctgatggtagtttgtatttctgtgggattggtggtgatatcccctttatcattttttattgcatctatttgattcttctctcttttcttctttattagtcttgctaatggtctttcaattttgttgatcttttcaaaagaccagctcctggattcattaattttttgaagggttttttgtgtctctatttccttcagttctgctctgattttagttatttcttgccttctgctagcttttgaatgtgcttgctcttgcttttctagttaattgtgatgttagggtgtcaattttggatctttcctgctttctcttgtgagcatttagtaccataaatttccctctacatactgctttgaatgtgtcccagagattctggtatgttgtgtctttgttcttgttggtttcaaagaacatctttatttctgccttcatttcgttatgtacccagtagtcactcaggagcaggttgttcagtttccatgtagttgagtggttttgagtgagtttcttaatcctgagttctggtttgattgccctgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatatctattaggtctgcttggtgcagagctgagttcaatttctgggtatccttgttaactttctgtctcgttgatctgtctgatgttgacagtggggtgttaaagtctcccattattattgtgtggcagtctaagtctctttgtaggtcactcaggacttgctttatgaatctgggtgctcctgtattgggtgcatatatatttaggatagttagcgcttcttgttgaattgatccctttaccattatgtaatggccttctttgtctcttttgatctttgttggtttaaagtctgttttatcagagactaggattgcaacccctgcctttttttgttttccattttcttggtagatcttcctccatccctttattttgagcctatgtgtgtctctgcatgtgaggtgggtttcctgaatacagcacactgatgggtcttgactctttatccaatttgccagtctgtgtcttttaattggagaatttagcccatttacatttaaagttaatattgttatgtgtgaatttggtcctgtaattatgatgttagctggttattttgctcattacttgatgcagtttcttcctagccttgatggtctttacattttggcatgtttttgcagtggctggcaccggttgttcctttccatgtttagtgcttccttcaggagctcttttagggcaggcctggtggtgacaaaatccctcaacatttgcttgtctataaaggattttatttctccttcacttatgaaacttagtttggctggaatgaaattctgggttgaaaattctttcaagaatgttgaatattggcccccactctcttctggcttgtagagtttctgccaagagatccgctgttagtttgatgggcttccctttgtgggtaacccgaccttactctctggctgcccttaacgttttttccttcatttcaactttggtgaatctgacaattatgtgtcttggagttgctcttctcgaggagtatctttgtggcattctctgtatttcctgaatctgaatgttggcctgccttgctggattggggaagttctcctggataatatcctgcagagtgttttccaacttggttccattctctccgtcactttcaggtacaccaatgagacgtagatttggtcttttcacatagtcccatatttcttggaggctttgttcatttctttttattcttttttctctaaacttctcttctcacttcatttcattcattttgtcttccatcactgataccctttcttccagttgatcgcatcagctcctgaggcttctgcattcttcatgtagttctcgagccttggctttcagctccatcagctcctttaaggacttctctgcattggttattctagttatccattcgtctaattttttttcatagtttttaacttttttgccattggtttgaatttcctcctgtagctcggagtagtttgattgtctgaagacttcttctctcaacttgtcaaagtcattctctgtccagctttgttccattgctggtgaggagctgcattcctttggaggaggagaggcactctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactccagaccctgtttgcctgggtatcagcagcagtggctgcagaacagtggtggctgtagaacagtggatattggtgacccgcaaatgctgctgcctgatcgttcctctggaagttttgtctcagaggagtacccggccgtgtgaggtgtcagtctgcccctactgggggttgcctcccagttaggctgctcgggggtcagggaaacacttgaggaggcagtctgcctgttctcagatctccagctgcgtgctgggagaaccactcctctcttcaaagctgtcagacagggacatttaagtctgcagaggttactgctgtctttttgccctgcccccagaggtggagcctacagaggcaggcagtcctccttgagctgtggtgggctccacccagtttgagctccccggctgctttgtttacctaatcctgggcaatggcaggcgcccctcctccagccttgctgccaccttgcagtttgatctcaagacagttgtgctagcaatcagtgagactctgtgggcataggaccctccgagccatgtgcgggatataatctcctggtgtgccgttttttaagcccattggaaaagcacaatattagagtgggagtgacccgattttccaggtgccatctgtcacccctttctttgactaggaaagggaactccctgaccccttgcacttcccgagtgaggcaatgcctcgccctgctttggcttgcacacagtgcgctgcacccactgtcctgcatgcactgtctggcactccctagtgagatgaacccggtacctcagatggaaatgcagaaatcacccatcttctgcatcgctcatgctgggagctgtacaccggagctgttcctattcggccatcttggttccacccctctaactcatcttttaagccttaggataaatgttttcctcagaacatctgaatgaatgaataaagccaccgtaacatatgggacatcataaaacaacaaaatatttgaatttttgaggtcctagagacaaagagaaaacataaaggatagaaaatctatttaatgaaataatagcaggaaactttccaactctagtaagagatgcagacatcttgatacaggaagctcagagatacccaaatagatacaatacaaaaaggtcttctccatggcatattatggtcaaaatataaaagtcaaagacaaaagagaatactaaaaacagcaagagaaaagcatctagtcacttacaaggaaactctcatcagcctaacagcagatttctcaacagagagaaatgagagagaatgtgattatacattcagtgttgaaagaaaaaaatcaccagtcaaggacactatcctcagcaaagtattctacaaaaatgaaaaagaaatagtctttcccagacagcaaaaggtgacagaattcatcaccactggaccaaccctacaagatatgttcaagagtcctacacctagaagtgaaaggacaatatctaccattgtgaaaacacacaaaagtataaaacctactgacacagcaaacatacaaataaggacaaaggactcaaatgttacccctaaagaaaacaaccaaaccacaatgataaaaaataaaagagaaaggaacaaaggataaacaaaacaactagaaatcaattaataaaatgataagaatcagccctcacatatcagtaatcacactgaacgtcaatggattaaacttcatttaaaagatacagacgggctgaatggatgaaaaaacatgatccaactataagctgcctacaagaaactcttctcactggtaaagacacatatggattgaaagtaaaagaacaggaaaagatattccatacaaatggaaaccaaaagtgagtagaaatagctacgtttatatcagaaaaaaacagattttaagtaaaaaacagcaaaaagagacaaagaaggtcatcatataatgataaagggatcaattcagcaagagaatataacaattctaaacatataacaccaacaccagaacacccagatatataaggcaaatattattagagcaaaagggagagagatactacagtataataatcactggggacgtcactgtgccactctcagaattagatcatctagagagaaaattaacaaagaaacattgggtttaaacatacctgagaggatgagggaaaaagggaactcttatatactgttggtgggatataaattagtacaatcactatggaaaacagcatgcagatttctcaaaaacctgaaaatagaactaccatatgatccaacaatcccactactgggtattaatccaaaggaagataaaatcagtatatcaaaatgatacctgcacttgtatgattactgtagcattattcaaaataccaaaggtatggaatcaacctaagtgtcccccaacagacaaacagataaagaaaatgtgatatatacacatggaatactattcaggcatttaaaaaatgaaatcatgtcatttgcagcaacatggagggaatcggaggtcagaaagacaaatatcagactgggcgcagtggctcacacctgtaatcccagcactttgggaagccgaggtgggtgaatcacctgaggtcaggaatttgagaccagcctggccaatgtggtgaaaccctgtctctattaaaaatacaaaaattagccaggcgtggtggcaggcacctgtaatcccagttactctagaggctgaggcaggagaattgcttgaacccaggaggtggaggttgcagtgggccaagatcgcaccactgcactccagcctgggcgacaagaatgagactccaactcaaaaaaaagaaagacaaatatcatatgttctcattcatatctggaggctaaaaaaagatctcacagaggtaaagaatagaatgatagaaaccagaggctgggaagggtgtgtgggtgaggggtgggggatgaagaggagttggttaatgttacaaacatacagttaaatatgaggaatgacttctaatgttcataagcagagtagagtgactctaattaacaacaatgtattgtatatttcaaaatagctagaagacttgaaatgttcctatcagaaagaaatgataaaccctcctctggtggatctgatggatacctcaaataccctgacacttgttcattacaccttctatgcatggaacaaaacataacatgtatcccataaatatgtacaaatattgggtatcaattaaaaatgaataaataactcttgaagaacttcccacattcctcacaacgacagtcaaaaccctgtatgatacgactccgacgtaactctcagacctttcttcccgctgttccattacttactccacctttgtgtttcctgctcagtctgactagagtacttgaacacttacttcacatctctatgcaagcaagcccacttccagacaggtaccctaagcacccaagtgctgccattctcaccccatcactcctatttccttgtctctatagcatgattatttggtattccttatctattcatttgcttacttgtttgaggcatgtctcaccaactgctggtaaagtccatgacagcagtgactttctcagtcttgttcattacctgtacattacagtattgaccagagccaagcatatgccttctaggaatgcgcactctatacatatttactgaacatgaatacatttcttagtgaaaacacatgtagaaatctaaatgcaaaagcagagttggaaagtagctggatccaaaatacgtgttaaaagtttacactgggggccagaagcattggctcatgcctgtaatttcagctacttaggaggttgaggcaggaagactacttgaggccaagagttcaagatcagctggggcaacatagcaagatgctgcctcttaaaaaataattttaaaaactgtttaaagtttacactgggaaagaaagaggaagctcacttcattaaaagaggaagaaaataacagaaattaggtgattagtaaatgatgaagttccttggggacagctcctacagtgatcttatttccttcccaggtcttgggcatttttgtccagtgggggaccttgggttattgaagaaagttttccaaaccacatctcaggggtgtgactcctctctgagcacatgggctgtccgggacaatgatggcttccccctgcctgctttactctcacttacctggataccatctgcttgtttctttacttacaacaatccagggctctttctcttgctctagtaatgtaatcacatctggcttagaaatggaacttcctgcttaaaagaaataacacatgtagaatttttttaatataaaaattttttttaaaccctgagacctagttaaacttataataaattacaagccaaaacaatattgagaagagactccagataagagaggattgagtaagggatcaactatgtttaaaaaaaaaaaaagcactttcatttaaactcataatagaaacttatccctcaagaggaggtataatttagtggttaacagcaggaaacttcaagccagattacctggttgaaatcctgtctctgccacccactagtactttgacattaagtaagtcacttgaactctctgtccttcagttttcccaactctaaaacagaaatataataatgcctgttttataggattgatactaatattaaataaggtaatatatgtaaaatacttctaactctcactcatacgtagtagcacaaagttaaaaattattatgtttattgtcattatttattttgcatccttagacatttacagctcattttaagaattttcacccaacagaaaagcatacacttcatggcctgaaactttcaactacaaaacaagtaacggaaggtctgtcgaaggaaatggaatatactgacttagtgctaaataagttctgtcaacccaatcagtatatgtaaatcattgaggctctgttttgttttgtttttttgagacagtgtcttgctctgttgcccaggctgaagtacagtggcatgaccacggctctctgcagccttgacctcccaggttcaagcaatcatagaggctcttttaatagaaaaactcaacacactcttctccttacaggtgggccagaaaaacaaaaacaaacaaagaaaatctacagtaattctgagatcaaacataatatgaaacctggttcttgaacaatatcattcaacgaatatacaagatttcaaattcagccccatggtcatgaagagagagaggggattacagagatgaccagcataatggaggaggccctggtgcagtaggcaagatgcagaggctccaaggaggtgcctgttttcaacccaacaaatctcaatccattccttcgggaataagaagaaggaatccaactacctcttaaaagacagccctgaaactcatgatgaagaaagctgatattccagagaacagatacaaaaataactgggaccaatgaccttacccagtgatatcaggtggctgtagttctccaacatcacatccctgtacaaggtcctctgatcaggctgcaggcactcccactcctcctgagagaagtcaatggccacatccctgaatgtcactgatccctgaaaccacaaacacatggattatggtgaaattgaagaaagttgtttcaagacgaaaggagaggaagtgaaggattaaactgcaataaaggagcaatatggaaaatcgcagagtgcctacacattcttcaagaatcctgctgctggcctggtgtggtggctcatgcctgttataccagcactttgggagaccaaggtggaaggactgcttgagcccaggagttggcaaacagcctgggcaacataacgagatgcactccctggaaaaaaaaaaaaaagaaagaaagaaagaactgtcgtggtggcatgtgcctatagtcccagctacttgggaagctgaggtgggagtattgcttgagcctgggagttcaatgctgcagcgaagtgtgatggcactactgcactccagcctgggctacagagtgagaccctatctcaaaaaaaaaaaaaaaaaaaaaaaaaaggtggcagcatacaattgaggaatgccgttaatcctcaagcttactgtggtatcagatgatagcaaaagtattttttcttgtcatgacaaatgatttttataagctgcgtaaaattcaaaataactgacatattagatttagtcatatttttctatttatacatttaagatggtcagagtctctaaggttttcccaaattcagagaatctgtaatcacctaccactcatgccctgaataatctctgttactgcccactgtcctcactgatcactttcctaaaagcctcataaagcagaacaccttgtcacgcttgcagactgaggccactcactatggaattctacctcagctacctagaaagctccagtctgtggaggagtttcaaggtgttcccgagtgtggtcaaatgcgacaatcatctgtaacttatcaaacccacaagaccatgtttccctgtggggaccaactcctccactgttccaacattctttctgaccaaggactgagttaagcacagactgaataacctgctcaaagaaaacatcaaagccagtgggaaaacagaggtacgaataggaagagcactgacttttattttttggtcaccaaacttcactgtaatgggacaaagtggggtgtaagattgtggatcctggccaggcacagtggctcacgcctgtaatcccagcactgtgggaggccaaggcagggggatcatgaggtcaggagatcgagaccatcctggctaatatggtgaaatcccatctctaccaaaaatacaaaaaattagccaggcgtgctggtgggtgcctgtagtcccagctactcgggagtctgaggcaggagaattgcttgaacctgggaggcggaagttgcaatgagccaagatcgcaccactgcattccagcctgggtgacagagcaagactccgtctcaaaaaaaaaaaaaaaaaaaaaaaaaaatcgtggatccttacgtaagaaggttcaggtttaataataacagtcacctaacctaacctgaaagtcaccatatttcaagaagacagaaacaccaacttacatggaccatgtttctagaattacaaaattggtcaatcttcctcgggcttctcccctggaaaacaacaacaacaaaaaggccctaagtcaagctgtgtccgaaagcactagaacgaataaatattttatcctccattcctatttctcaactactcctgctcacacgcacacttccacccttctcccgtcactccctttttccctacacacactctcacaaataaactggcagtgaacaggtggagtgtggatgaaaccaagctctcgcctacatcccagggaacctgcggcggaagcatgaatgccgagcacaggcatttctgccttgaagttgtggcttccagccagtcctccactcttgggataccaatcttggcctaggactgggcctctgatcctgctgtaagcaatcctcctcccctagtccacctttcagagctgagaagggcttgcatcatccaatccagaacctctttgtgaactcaggattgggtgcagtggggcaaggcatgagaactggaaaggatatagacagaattgcatgggcagtgttcagcattctgagttcaccaaaagccagctggggtaagtacagttcagaatagccatgtaatagaatacaaagtaatcattaattgttccagacatatgattaacagaaaaatcaggttacaaagcaggataaacaatacgattacatttgtaaaatatatgtatatagaaatattaagcaaaagactaatagacatcaatacaaaaatttagacaggtatatgcatgctaacagtgcttatctctgtattgtagccccaattttcttctttttgctaaagagtatgtcataattgtgactatgcccaggcatttaacttagaatatataattatattcacacacacacacacacacacatatatacacacatatacacatgtgtatgtatctatatatgtacatatttaaatgtacatacacattttttttcttgcgaggaaattgttctccaaattagatgaaagacatcttttatttagacattttcctttcaacgtggggacaaaaaaaggaaactctactgagctcttgtttttatgtaataaatttgtttccattatttcccaattcttgaccaacactaagatgtctatgtttttctatgtatgttagtacaatttctaaaaaaaattgtctacaagtcttcaactaatttcttgtatgcattaatgatggtcatatttctacatccgaattcaaaaataaaaataaaacagagttaacagagagtgagtacttttaatcataaaaaacaaaaaactgtgcctgtcatgaggatcaaaaagattaatgtgactataacaaataacatcagctagttctgacatcctttagctgtatctcaccaatataattagacattttcattatcaagactcttctctgaatgaacacaatgcagataagtggcatctggaaactacatgagaaaatctgtggaatgtacatcaccatgcttggttcccttcttcaccaaataactcattaaaatatcattttggatacaattcctacagaatgccttacaaaaaccctatcttagtatatgggattcatatacatgtaacattttcttgagtatcattgttcatagcatgaatactgcttaatggtatatcaaatatttttcttttcataattctttatagacatcattttattagctgcataatactttatcacttgagtctagtataatttgcttagtgatttccatattacaggacacttgatttatataagatcatttacagtgtcattccaggtatcacaatcttttgattctagactaaggtttttcaccctaggcactaatgacatattgtgctgtataatcctttgttggggctatagggagggttatcctgtgcacggtacaatgttcagcagtatccctgacctctatccactagatctaagtagcacctcccccatggtgtgacaaccaaaagtttttaaacatcacccccgctgagaatcaatgttctatctagatcaatggatccaaacctcatgggtcacatacagttttgatagtcttatgaaatgatatactatttctccctctaaaacccacattgataaatttccatagtacttcaatacattatttcaagagctttgtggtccccaagaccatacgtggagttacaagaactcagattaagaatttcagtcctacattcttgacaaaaatagaaaaaaaaaaatcctaaaatgtgcatagaaccacaaaagacccaaatagccaaagcagtctggagcaaaaagaacaaagttggaggcatcaaactacctgacttcaatatatactacaaagctatagtaaccaaaacagcatgatactgacataaaaacagacacctagacaaacggaacagaatagagagccccagaataaatccatatgtttacaaccaactgatttttgagacaggtgccaagaacatacaataaggaaaagacagtctcttcaatacatactgttgtgaaaactggggagtcatacacagaagaatgaaattagacccttttctcaaaccattatacaaaaatcaactctaaatggattaaagatttaaatgtaagatcccaaactatgaaacaaatagaaaaaaacgtacggggaaagcttcatgacattgatctgggcaataatttttttttctagaaatgacttcaaaagcacaggcaataaaagcaaacatagacaaatgaaattacatcaagctaaaaaagcttctgcacagcaaagtgaagagactacctacagaatgagagaaaatatttgcagtcatgtatctaataaggggttaatatccaaaacgtgtgaggaactcaacagcaagaaaacaacccaattaaaaaatgggcaaaggacctgataaacacatctcaaaagacgacatataaatggctacagtatatgaaaaaatactcaacattactaatcatcagggaaatgaaaattaaacctacaataagatatcacctcatatgtgttggggtggctattgaaaagacataagttaacaaatgttggtgagaatgtagagaaatgtgaaccattgcacactgttggtgagaatgtaaagtgacacagacattatggaaaacagcatggaggttcctcaaaaaattagaaatagaaccaccatatgatccagcaatctactactggatatttatccaaaggaaatgaaatctgtataccaaagagacacctgcacacccatgtttattgcagcactattcacaatagccaagatatggaatcaatctaactgtctatcaatgaatggataaagaaaatgtggtatatatgcaggtatatatacacaatggaaaactagccataaaaaaagggaaatgctgtcattcgcaacaacatggatgaacctggagaaattcatattaagtaagccaagcacagaaaggcagatgatctcactcatcagtggaatctgaaaaatgttcatataggccaggtgcggtggctcacacttgtaatcccagcactttcgaaagcggaggcgaaggccgaggcaggcggatcacctaaggtccagagttcgagaccaccctggccaacatggcaaaaccctgtctctactaaaaatacaaaaataagctgggtgtggtggcatgcacctgtagtcccagctactcggaaggctggggcaggagaattacttgaacccgggaggcagaggttgcagtgaaccgagatcacgccactgcactccagcctgggcaacagagtaagacactctctctcaaaaaaagaaaacacttgatatcatagaattagagaagagaatggtgtttacaggtcgggggtaatgtgggtgagggagggaagatggtgttggctggggaaatgttggtcaaaggatataaaatttcaggaagataagagaaataagctcaagaaatctattacacaacaacgtatctactattaataactactattaataactattctgtagtgctaagagagtggatattaagtgttctcaccacaaaaatgataactatgtgaggtaatgcattgctaattagctagatttagtcattccacaatgtacatatactataaaacatcatgttgcacacgataaatacatacaattttatctgtcaatttaaaaagaacttctgtcctagatcatttgagcaactcactcattttcttactatgcaagcagcaatcacaatgaatcacatattcccaatgctcctgtcctatagaaagtcaagggaaatgacctaaaatgaccacacgaaaacaaaagctaaaacattaaacatttattattatatgcctagcactgctctaagaggttttagagtattaattcattctaatgttcattacaagcctgagaagaccagaaacggacagaacaaacattccaacccagatactctggatccactcccctattcttaaccgcaacagcgtactgcctctcacagttcacacaaatagcccaaaatgcaaccggaactgccgaatctcacagagatctggcaagtattacaattatcatctcatggactctcccgaaaaatcctgactctggttgataccaatttctgtgcaatcactttccgattcctgaaagcctcacagacgaatggaaatcacccaaccatctccattcttccctacttggaaaaggaggcctgtaaagagtcagaaacctggcgtgtgattccacaaactaatcttcttttcaaagcagagtctaaaataaagctttaatataaacctctggaggactatttttataccagcttagaagaagagagcgtacaggaaggtgtgaacgatttgccaaatggctctgtgaatattaaatggcaaggtggggagcgggcggggtggggaacggctcgctgggaggcggcacaatgggagggggcaagaatcaatttgcatattctcctgaaattcactaaaaatttacaggaacctctatattctaaaatcaaaaacgcatttcttgaacaaatacaaagcacaaactcacccttgacttaagtgtgcaacaataacgctctcatcctcctctcggtccttcttttggataataatacgactggagaaggatacggcaagcgtgagactccaggcttttcttggagcgcagactaagtttgaaagcaccctccatggccacaacttccctcacttcgtacgaaatgagaaggaaataaaaggaggaggaatcggtctgagttcgaagctggttcctggggacagatctctgagggacgctgggttctcaacatgtagctgccctcctgggggaccctcaagaggcacttccagctctcatattcccaccccgagtccagatctgcgccttcttgtgcaaagct

SEQ ID NO: 491 - DNA, 531 bp, Homo sapiens
tttttttttttttttttccatactgtagtttttgaattttcagtcattcctgcgcttggcacccagtatgcactcaagcaaatgtcagcaatacaaatgaatccaggacttttgactcctaattcagagactctccaactctgcccgaattctggaagacttgcattaattacaataattatggaactattttggagctctacttttgaagctgctttcggagcctgtttataaaccacaaagaaagtcagtcttattaaaactgtcaaacttcattaatgacccaacctgaaaatccataacaatatctaaacatagttttttttttttttttttaaagaaaatctccaaacacatcgagtgctatatgttaaatacctaaagcttttagtatgtcagtcatacctcaataaggtggtttgggggaaaaagaaagcacaaatcgacattcagaggatggtgaaatgctcccatgaagacaaccaagcaaatataccatatacaccttcgtaattcatgatctctgtactc

SEQ ID NO: 492 - DNA, 1548 bp, Homo sapiens
  modified_base (88)..(88): a, c, g, t, unknown, or other
gccgggcgtatgtgttggtgctagaggcagctgcagggtctcgctgggggccgctcgggaccaattttgaagaggtacttggccacgncttattttcacctccgaccttttccttccaggcggtgagactctggactkagagtggcttttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgygcttttactgaagccagtgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaaaaaaaaaaaaaaa

SEQ ID NO: 493 - DNA, 546 bp, Homo sapiens
aaggttgaaattaggaatttcttttttaatggccactaaagtcctagcaagtttctgacagaagcacagacagaaaatggaaacaaataccttactgggaatgtttccttgcttgcactaaccatgactacagcaataacgcattgcttaacagtcaaagtgcaccaggtcatttccgcaaatggcagggtgagtgactgtgccgttcccaaggaagcaaaacagacacaaacaggtcccacgcgctgggtgtcctggctgagtacagaggaggctgctagaccggcagtacccttttcccaagtgaggaaagacagctgtgacactctgcatgccggcaggtgtccacaccctccactccaccatctggcccatagctgtaccaacaattacattttcttccagcttccacttcatttcctacttttacagcatttcatcctctcctttatgcagcctttacaaataagatcagaaatgtgtccaaacaagtgcattaagataggcccctattggccaagtcaaagagctctcacacatgggtgg

SEQ ID NO: 494 - DNA, 1710 bp, Homo sapiens
ggggctggcaagcgcttcctgcgcagcgccgaggcgacctggagtttgtgacgctgtgatggtctagaggctggagattcaagatctgggtgccatcattttctggttctgttgatgaccctcttccagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcatagtacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcattttgagttccagctggtgcttctttatatttagaaattataatgggaaggccatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctctcaaaaaaaaaaaaaaaaaaaaaaaaaaaaaa

SEQ ID NO: 495 - DNA, 2881 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 496 - DNA, 3868 bp, Homo sapiens
atgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggtcttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagcttacgggtgaagctcagagaagggtcggatctgagagaatggggaggcctgagtgggagtggggggccttgctccacccccatcccctactgtgacttgctttagcgtgtcagggtccaggctgcaggggctgggccaatttgtggagaggccgggtgcctttctgtcttgcttccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagacgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatcacttttttttttaagaaaaaaaagagaaatgaataaagaatctactcttcg

SEQ ID NO: 497 - DNA, 621 bp, Homo sapiens
tttttctgtatctaatggattatgccgctctggaacattcatgtgatgcttttgttaattgcttatacattttattaagctaatgagcttggtcatagtaacatataaaatcaagaatcgtttaacttttgcaataaaaatcttgatgttgactctgaagtagtaagatgcaacttcaatgtactgggattgaggcagccatagcaatattaccacaggttttccaaaaattaacacaaatattttctattctagatgtgatatctttggcatcactgttcattcttttcctccttgattaaagtgaaacaattacattaaaatagttttatgatttaaaaatcattctttttttaagctattatttttaatgtaggtcagtgtgttatgtaaattgatgtccactacctgaacatgtgatgctttctcttttattccttggtatttcctccatattctctgagggccttcagtcaatttttttaaaggaaataataagttcaaatatgtatctatgacttagggttacaaagaatattttctttgcctccagtatactttgtattaaaaaaattataaaagggcataggttttcattttcaaatatttgaaaaaaaaggc

SEQ ID NO: 498 - DNA, 454 bp, Homo sapiens
agagacattatctgtttaataaatatgattgtaaaagcaataaacaagagcaattatacattacactacatagtatttaacaaaaaatacatcaaaaaagtcattttaaaattagaagtagttccaatactataagaaaactttttttttttttaattggcttcctataaaaataagtcggcaaatgagagatttcaatgctcagttggattcctggaaaacacagaacagctgccaagcaccccactgctctcaaagttgctgtttggaacttctgaaaaaaaaaagcaaagcaaacctctgcattttggacagtgaatccaattaaaaataaggcaaggtagaaagtgttgcttgggtggttcagggtagaacatgcacagtttgccttctgggattttggaaaacgttgcagtatcggatttttagcttgccctgaatcttaccttccaca

SEQ ID NO: 499 - DNA, 1322 bp, Homo sapiens
gggtcgaggtcgacggtaacaaaagttttttttttgctttttaaaaaattcaatgttagcaagagaatgataagtttgggagcttcatatgatgctttagaagtgtaaatttcctttctgataagcagctaagcaagctatatcaggaatgtagctttttggttgttttttgagatggtcttgcgttgttgcccaggctttgagtgcagtggcatgatcatggctcactgcagcctcaacctccctgactcaagcgatcctcccacctcagcctcccaggtagctgcgactacaggcacgcaccactccactcggctaattttttattttttatttttgtagagacagggtcttcctatgttgcccaggccagtctctgaactcctgggctcaagtgatccttctgccttggctcacacctataatcccagcctcccaagtagctgggactacaaggcacctactgctgcacttagctttatcttttaactcatattttaaatgtcttctacaaggcaccgaaaaataagtagttgtgttcatttttaagtaaatagtagtaaacagtttcaaatgctgtttgagatgttaattaaggcacacacttagactagtccatttgatttgaaaattaggattttatttgtgctttttgttaattactggcttttaaaagatcagtagtggggcagaaactagactagtgggttgaagggtgaataggaaataagtaatacttattctttcaaggagctcgactgaaaaggagacagtggtagtttgaagatattgctgtttttaagataaaaatgatttcagcactttaaaaataaaaagttggaaatgatcaatgaatcaaggatcatcaagaaagaggcaagaggaagtaagattaagcacaaagagtatcaactgataggtggcatttcaaggaacttcaggtgttgaatatctaaagcaccaaatgcgtgtggacagcagtgaagataaagctggaaatgcgccggcagaccaacacatgatgagccctgtaggtggtggacaaagactacgagcaagccatttaggcaaacatctgaagaatttaaaaatcaaaggcaaacaaataggactgtttcattaagatcacttgcattctaacaggttatgatgaatggaaagctgatggttcctggttggaaaaaagataattttcaatttggacatgtcacatttgagatgcagttgacacacccaagatacataatatattgtctttcaaaattcagaaacctaataaaccatgatcttaataaccgccaaaaaaaaaaaaaaaaaaaaac

SEQ ID NO: 500 - DNA, 4098 bp, Homo sapiens
atgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggccccgacagcccggtctccccaatgaaggagctgacccatgcagtgcacaagcagcagagggccctggaagcgaggctggaggcctgcctggaggagctgaggagactctgccttcgggaagcggagctgacgggcaccttgccagcggagtatcccctcaaaccaggggaaaaggcccccaaggttcgccgcaggatcggagcggcttacaaactggatgactgggccttgcacagagaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgagagctcagtgcctctgatgacagctccctgtcagatgggctcctcctggaggaagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgtgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgaccccactcactggaccgccaaggagctttccgggtcaggagcctgccccttgggagagagggcttcggacgagccctgggaccccgggcacaggtgcccacagtttgtgtgctgtggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctaagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctggacatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttctgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggtttttgaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg
